(12) United States Patent
Balatskaya et al.

(10) Patent No.: US 8,030,051 B2
(45) Date of Patent: Oct. 4, 2011

(54) ALANINE 2,3-AMINOMUTASES AND RELATED POLYNUCLEOTIDES

(75) Inventors: Svetlana Balatskaya, Fremont, CA (US); Birthe Borup, Redwood City, CA (US); Ranjini Chatterjee, Belmont, CA (US); Ish Dhawan, Foster City, CA (US); Richard J. Fox, Kirkwood, MO (US); Kenneth W. Mitchell, Sunnyvale, CA (US); Emily C. Mundorff, Belmont, CA (US); Les Partridge, San Francisco, CA (US); Matthew Tobin, San Carlos, CA (US)

(73) Assignee: Codexis, Inc., Redwood City, CA (US)

( * ) Notice: Subject to any disclaimer, the term of this patent is extended or adjusted under 35 U.S.C. 154(b) by 1187 days.

(21) Appl. No.: 11/581,946

(22) Filed: Oct. 16, 2006

(65) Prior Publication Data

US 2010/0248312 A1    Sep. 30, 2010

Related U.S. Application Data

(60) Provisional application No. 60/726,967, filed on Oct. 14, 2005.

(51) Int. Cl.
*C12N 9/90* (2006.01)
*C12N 1/20* (2006.01)
*C12N 15/70* (2006.01)
*C12P 13/06* (2006.01)

(52) U.S. Cl. ............... 435/233; 435/116; 435/252.3; 435/320.1; 536/23.2

(58) Field of Classification Search ............ None
See application file for complete search history.

(56) References Cited

U.S. PATENT DOCUMENTS

| | | | |
|---|---|---|---|
| 6,248,874 B1 | 6/2001 | Frey et al. | |
| 7,309,597 B2 | 12/2007 | Liao et al. | |
| 2002/0173637 A1 | 11/2002 | Frey et al. | |
| 2003/0113882 A1 | 6/2003 | Frey et al. | |
| 2005/0221466 A1 | 10/2005 | Liao et al. | |
| 2009/0031453 A1* | 1/2009 | Jessen et al. | 800/298 |

FOREIGN PATENT DOCUMENTS

| | | |
|---|---|---|
| WO | WO 01/16346 A1 | 3/2001 |
| WO | WO 02/42418 A2 | 5/2002 |
| WO | WO 03/062173 A2 | 7/2003 |
| WO | WO 2005/118719 A2 | 12/2005 |
| WO | WO2006-022664 A2 * | 3/2006 |
| WO | WO 2006/047589 A2 | 5/2006 |
| WO | WO 2007/047680 A2 | 4/2007 |
| WO | WO 2007/047773 A2 | 4/2007 |

OTHER PUBLICATIONS

Abe, T. et al., 1998, "High-performance liquid chromatographic determination of β-alanine, β-aminoisobutyric acid and γ-aminobutyric acid in tissue extracts and urine of normal and (aminooxy)acetate-treated rats," *J Chromatogr B*. 712(1-2):43-9.

Chen, D. et al., 2000, "A novel 2,3-aminomutase encoded by the yodO gene of *Bacillus subtilis*: characterization and the observation of organic radical intermediates," *Biochem J*. 348:539-549.

Chen, D. et al., 2001, "Identification of Lysine 346 as a Functionally Important Residue for Pyridoxal 5'-Phosphate Binding and Catalysis in Lysine 2,3-Aminomutase from *Bacillus subtilis*," *Biochemistry* 40(2):596-602.

Chirpich, T. P. et al., 1970, "Lysine 2,3.Aminomutase purification and properties of a pyridoxal phosphate and s-adenosylmethionine-activated enzyme," *J Biol. Chem* 245(7):1778-1789.

Dalluge, J. et al., 2005, "Discovery of enzymatic activity using stable isotope metabolite labeling and liquid chromatography—Mass spectrometry," *Anal Chem*. 77:6737-6740.

Genbank Accession No. AAB81159.
Genbank Accession No. CAB13860.
Genbank Accession No. AE017175.

International Preliminary Examination Report & Written Opinion of PCT/US2005/038552 issued May 1, 2007.

International Search Report of PCT/US2005/038552 dated Feb. 26, 2006.

Kunst, F. et al., 1997, "The complete genome sequence of the Gram positive bacterium *Bacillus subtilis*," *Nature* 390:249-256.

Lieder, K. et al., 1998, "S-Adenosylmethionine-dependent reduction of lysine 2,3-aminomutase and observation of the catalytically functional iron sulfur centers by electron paramagnetic resonance," *Biochemistry* 37:2578-2585.

MacBeath, G. et al., 1998, "UGA Read-Through Artifacts—When popular gene expression systems need a patch," *Biotechniques* 24:789-794.

Parker, J, "Errors and alternatives in Reading the Universal Code," *Microbiol. Rev.* 53(3):273-298.

Petrovich, R. M. et al., *J Biol. Chem*. 266(12):7656-7660.

U.S. Appl. No. 11/919,271, filed Oct. 25, 2005.

* cited by examiner

*Primary Examiner* — Anand Desai
*Assistant Examiner* — Iqbal H Chowdhury

(57) ABSTRACT

The present disclosure relates generally to polypeptides having improved alanine 2,3-aminomutase (AAM) activity, the polynucleotides encoding the AAM polypeptides, and expression vectors and host cells for expressing the AAM polypeptides.

3 Claims, 4 Drawing Sheets

ALANINE 2,3-AMINOMUTASES AND RELATED POLYNUCLEOTIDES

1. CROSS REFERENCE TO RELATED APPLICATIONS

This application claims benefit under 35 U.S.C. §119(e) to application Ser. No. 60/726,967, filed Oct. 14, 2005, the contents of which are incorporated herein by reference.

2. REFERENCE TO SEQUENCE LISTING

The "Sequence Listing" submitted concurrently herewith on compact disc under 37 C.F.R. §§1.821(c) and the computer readable form (CRF) of the Sequence Listing submitted under 37 C.F.R. §§1.821(e) are incorporated by reference herein in its entirety. Two copies of the Sequence Listing, one on each of two compact discs labeled "Copy-1" and "Copy-2," are provided. Each electronic copy of the Sequence Listing was created on Oct. 16, 2005 with a file size of 18,633 Kbytes. The file names are as follows: Copy-1-377804-008_CRF.txt and Copy-2-377804-008_CRF.txt. The "Sequence Listing" incorporated herein by reference is the same as the CRF of the Sequence Listing being submitted concurrently herewith.

3. TECHNICAL FIELD

The disclosure relates to compositions and methods involving biocatalysts for the efficient production of useful chemical products.

4. BACKGROUND

Organic chemicals such as organic acids, esters, and polyols can be used to synthesize plastic materials and other products. To meet the increasing demand for organic chemicals, more efficient and cost-effective production methods are being developed which utilize raw materials based on carbohydrates rather than hydrocarbons. For example, certain bacteria have been used to produce large quantities of lactic acid used in the production of polylactic acid. 3-hydroxypropionic acid (3-HP) is an organic acid. Several chemical synthesis routes have been described to produce 3-HP, and biocatalytic routes have also been disclosed (WO 01/116346). 3-HP has utility for specialty synthesis and can be converted to commercially important intermediates by known methods in the chemical industry, e.g., acrylic acid by dehydration, malonic acid by oxidation, esters by esterification reactions with alcohols, and 1,3-propanediol by reduction. The 3-HP compound can be produced biocatalytically from phosphoenolpyruvate or pyruvate through a key beta-alanine (β-alanine) intermediate (FIG. 1). β-alanine can be synthesized in cells from carnosine, β-alanyl arginine, β-alanyl lysine, uracil via 5,6-dihydrouracil and N-carbamoyl-β-alanine, N-acetyl-β-alanine, anserine, or aspartate (FIG. 2). However, these routes may not be cost-effective because they require rare precursors or starting compounds that are more costly than 3-HP. Therefore, production of 3-HP using biocatalytic routes would be more efficient if alpha alanine (α-alanine) could be efficiently converted to β-alanine directly (FIG. 1). A naturally occurring enzyme that inter-converts α-alanine to β-alanine has not yet been identified. It would be advantageous if enzymatic activities that carry out the efficient conversion of α-alanine to β-alanine were identified, such as an alanine 2,3-aminomutase (AAM). Enzymes having very low levels of AAM have been evolved in the laboratory (WO 03/1062173).

There are naturally occurring enzymes known to interconvert lysine to β-lysine. Lysine 2,3-aminomutase (KAM) was first described by Barker in Clostridium SB4 (now C. subterminale) as catalyzing the first step in the fermentation of lysine. KAM has been purified from C. subterminale, the corresponding gene cloned and expressed in E. coli (e.g., U.S. Pat. No. 6,248,874, incorporated herein by reference). The specific activity of purified KAM from C. subterminale SB4 cells has been reported as 30-40 units/mg (Lieder et. al., 1998, Biochemistry 37:2578), where a unit is defined as μmoles lysine/min. The corresponding recombinant KAM had equivalent enzyme activity (34.5±1.6 μmoles lysine/min/mg protein). See U.S. Patent Application Publication No. 2003/0113882, the whole of which is incorporated herein by reference.

Based upon the sequence of the KAM from C. subterminale, KAM genes have been annotated in the genomes of other organisms. However, in most cases, the enzymatic activities of the polypeptides encoded by these genes have not been confirmed. Exceptions are the B. subtilis gene (Chen et al., 2000, Biochem. J. 348:539-549), and the Porphyromonas gingivalis and F. nucleatum genes. The B. subtilis KAM, encoded by the yodO gene, is more resistant to $O_2$ than the C. subterminale KAM, but it is markedly less active. As reported in U.S. Patent Application Publication No. 200310113882, the B. subtilis KAM has a specific KAM activity of only 0.62 U/mg.

C. subterminale SB4 KAM has been reported to have some cross-reactivity with L-alanine, converting it into β-alanine. See U.S. Patent Application Publication No. 2003/0113882 A1. The publications WO 03/062173 and WO 02/42418 disclose the first reports of AAM activity based upon modification of kam genes. In these applications, the synthetic aam genes had AAM activity as detected by the complementation of an E. coli ΔpanD strain. However, because alanine is not the natural substrate for this enzyme, the activity for this conversion is substantially less than the activity for conversion of lysine, its natural substrate. Such low AAM activity would not provide a cost-effective route to converting α-alanine to β-alanine.

The polynucleotide for the wild-type lysine aminomutase (KAM) of Porphyromonas gingivalis, designated as Pgaam, has the polynucleotide sequence of SEQ ID NO:1 (GenBank Accession No. AE017175) and encodes the 416 amino acid residue polypeptide of SEQ ID NO:2. The polynucleotide (SEQ ID NO: 1) encoding this molecule was modified (SEQ ID NO: 3) as described in WO 03/106217, to produce a polypeptide (SEQ ID NO:4), designated as Pgaam2, having a detectible AAM activity. The polypeptide of SEQ ID NO:4, which exhibits a detectible AAM activity, differs from wild-type P. gingivalis Pgaam by having the following seven (7) amino acid substitutions: N19Y, E30K, L53P, H85Q, I192V, D331G, and M342T.

The percent homology between the amino acid sequences of the various KAMs from B. subtilis, C. stricklandii, F. nucleatum, and P. gingivalis are shown in Table 1 below.

TABLE 1

|  | B subtilis | C. stricklandii | F. nucleatum | P. gingivalis |
| --- | --- | --- | --- | --- |
| B subtilis | 100% | 53% | 50% | 52% |
| C. stricklandii | 53% | 100% | 69% | 72% |
| F. nucleatum | 50% | 69% | 100% | 70% |
| P. gingivalis | 52% | 72% | 70% | 100% |

The present disclosure is directed to engineered alanine 2,3-aminomutases having improved activity over those AAM enzymes known in the art.

5. SUMMARY

The present disclosure relates to engineered polypeptides and polynucleotides encoding the polypeptides having improved alanine 2,3-aminomutase (AAM) activity relative to the wild-type polypeptide from *P. gingivalis* of SEQ ID NO: 2 and the polypeptide of SEQ ID NO: 4, which is derived from the *P. gingivalis* polypeptide of SEQ ID NO:2. In some embodiments, the AAM polypeptides with improved enzyme activity has at least about 80% sequence identity with the amino acid sequence of SEQ ID NO:4.

The engineered AAM polypeptides can have from 1.5 times to 30 time or more times greater enzyme activity as compared to the AAM activity of the polypeptide of SEQ ID NO:4, or other engineered AAM polypeptides disclosed herein. In some embodiments, the improved enzyme activity may have 1.5 times the enzymatic activity of the corresponding reference AAM enzyme, to as much as 2 times, 5 times, 10 times, 20 times, 25 times, 30 times, up to 50 times or more times enzymatic activity than the reference enzyme. In some embodiments, the engineered AAM polypeptides can have from 2 times to about 30 times more activity than the polypeptide of SEQ ID NO:4. In some embodiments, the engineered AAM polypeptides can have AAM activity that is from about 2 to about 10 times greater activity than the AAM polypeptide of SEQ ID NO:36.

In some embodiments, the engineered AAM polypeptides has an amino acid sequence corresponding to the amino acid sequence of SEQ ID NO:4 and includes one or more substitutions selected from the groups of substitutions provided in the descriptions, below. Thus, In some embodiments, the engineered AAM polypeptide with improved enzyme activity is a polypeptide having at least 97% homology to a polypeptide of SEQ ID NO: 295, 2068 or 2150. In some embodiments, the engineered AAM polypeptide has at least 98% homology to a polypeptide of SEQ ID NO: 258, 316, 350, 356, 790, 1006, or 1250. In some embodiments, the engineered AAM polypeptide has at least 99% homology to a polypeptide of SEQ ID NO: 14, 24, 58, 86, 100, 312, 336, 380, 318, 404, 444, 490, 550 or 774.

In some embodiments, the engineered AAM polypeptide with improved enzyme activity is a polypeptide having at least 99% identity to a polypeptide of SEQ ID NO: 2230, 2348, 2286, 2312, 2282, 2346, 2338, 2226, 2268, 2324, or 2240. In some embodiments, the AAM polypeptide has at least 96% identity to a polypeptide of SEQ ID NO: 2380 or 2378. In some embodiments, the AAM polypeptide has at least 95% identity to a polypeptide of SEQ ID NO: 2670 or 2666. In some embodiments, the engineered AAM has at least 93% sequence identity to SEQ ID NO. 4288. In some embodiments, the engineered AAM polypeptide has at least 95% sequence identity to SEQ ID NO. 4586.

In some embodiments, the AAM polypeptide of the present disclosure has an amino acid sequence selected from the polypeptides listed in the Sequence Listing, beginning from SEQ ID NO:6. In some embodiments, the AAM polypeptides are encoded by a polynucleotide selected from the polynucleotides listed in the Sequence Listing, beginning from SEQ ID NO:5. In some embodiments, the AAM polypeptides are encoded by a polynucleotide which hybridizes under high stringency conditions with the complement of the polynucleotide sequences in the Sequence Listing beginning from SEQ ID NO:5, and where the encoded polypeptide has greater AAM activity than the polypeptide of SEQ ID NO: 4.

In addition to the above, the present disclosure also provides variants of the AAM polypeptides listed in the Sequence Listing, beginning from SEQ ID NO:6, comprising a substitution, deletion, and/or insertion of one or more amino acids and having greater AAM activity than the polypeptide of SEQ ID NO: 4., SEQ ID NO: 36, or in some embodiments, SEQ ID NO:909. In some embodiments, the variants of the AAM polypeptides comprise conservative amino acid substitutions of the specific AAM polypeptides in the Sequence Listing, beginning from SEQ ID NO:6.

Further provided herein are polynucleotides encoding the engineered AAM polypeptides, corresponding expression vectors, and host cells comprising the polynucleotides operably linked to control sequences for the expression of the AAM polypeptides. The polynucleotide and expression vectors can be used in vivo or in vitro to produce the AAM polypeptides. In some embodiments, the polynucleotide encoding the engineered AAM enzyme is selected from the polynucleotides listed in the Sequence Listing, beginning from SEQ ID NO:5. As described above, in some embodiments, the polynucleotides encoding the AAM polypeptides with improved AAM activity can comprise polynucleotides that hybridize under highly stringent conditions to a polynucleotide selected from the polynucleotides listed in the Sequence Listing, beginning from SEQ ID NO:5. The polynucleotides, expression vectors, and host cells can be used in methods to express the engineered polypeptide, for example, by cultivating the host cell comprising the expression vector under conditions suitable for expression of the AAM polypeptide.

In other embodiments, the present disclosure is directed to various compositions comprising an engineered AAM polypeptide, such as a whole cell preparation, as a crude preparation, or as an isolated polypeptide, and a suitable carrier, typically a buffer, such as an aqueous buffer solution having a pH from about 6.0 to about 8.0. In some embodiments, the AAM polypeptides can be provided in a lyophilized form, wherein the composition can be reconstituted by the addition of an aqueous based composition. In some embodiments, the AAM polypeptide can be prepared in a substantially non-oxidized form, while in other embodiments, the polypeptides can be provided in its oxidized form, which can be reduced by the use of a suitable reducing agent.

The present disclosure is also directed to a method of producing β-alanine, the method comprising contacting α-alanine with an engineered AAM polypeptide described herein under conditions suitable for conversion of the α-alanine to β-alanine. The process can be carried out with, among others, whole cells that express the engineered AAM polypeptide, or an extract or lysate of such cells. The β-alanine may be optionally recovered from the cells.

6. BRIEF DESCRIPTION OF THE FIGURES

Figure 1:
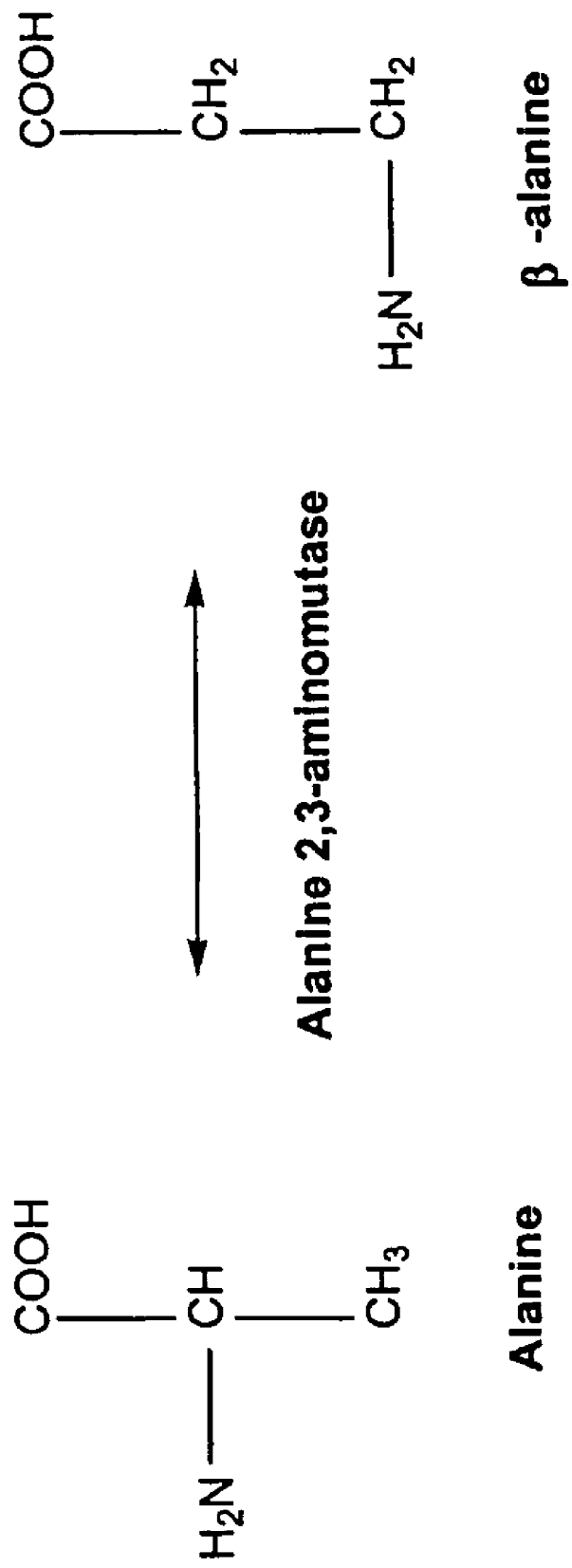
FIG. 1 shows the reversible reaction between alpha-alanine (i.e., α-alanine, L-alanine, or 2-aminopropionic acid) and beta-alanine (β-alanine or 3-aminopropionic acid) that is catalyzed by alanine 2,3-aminomutase.

The foregoing summary, as well as the following detailed description of certain embodiments of the present disclosure, will be better understood when read in conjunction with the appended drawings. For the purpose of illustrating the disclosure, there is shown in the drawings, certain embodiments. It should be understood, however, that the present disclosure is not limited to the arrangements and instrumentality shown in the attached drawings.

7. DETAILED DESCRIPTION

The present disclosure provides engineered alanine 2,3-aminomutases (AAM) capable of converting α-alanine to β-alanine. The enzymatic product β-alanine is a substrate in the pathway for synthesis of a number of different compounds, such as acrylyl-CoA, 3-hydroxypropionic acid (3-HP), 1,3-propanediol, and panthothenic acid, which have important commercial uses. For example, the compounds can be used to synthesize polyacrylates, acrylate esters, polymerized 3-HP, co-polymers of 3-HP and other compounds such as butyrates and valerates, esters of 3-HP, and malonic acid and its esters. In particular, 3-HP has biologically and commercially important uses, for example as a food additive or as a preservative. Hydrogenation of 3-HP results in 1,3-propanediol, a valuable polyester monomer. The engineered AAM polypeptides described herein are useful in efficiently generating the key intermediate β-alanine. For the description of the various embodiments herein, the technical and scientific terms used will have the meanings commonly understood by one of ordinary skill in the art, unless specifically defined otherwise.

7.1 Definitions

As used herein, the following terms are intended to have the following meanings:

"Alanine 2,3-aminomutase" or "AAM" refers to an enzyme which can convert α-alanine to β-alanine. The term also includes any alanine 2,3-aminomutase gene, cDNA, RNA, or protein from any organism, such as a prokaryote, or an engineered polypeptide with AAM activity. For example, an AAM can be a mutated lysine 2,3-aminomutase or a mutated lysine 5,6-aminomutase which has alanine 2,3-aminomutase activity. Lysine 2,3-aminomutases (or genes annotated in genetic databases as lysine 2,3 aminomutase) can be obtained from any organism, such as a prokaryote, for example *Bacillus subtilis, Deinococcus radiodurans, Clostridium subterminale, Porphyromonas gingivalis* or *E. coli*, and mutated using any method known in the art.

"Alanine 2,3-aminomutase activity" as used herein is meant that a polypeptide catalyzes the reaction of FIG. 1, whereby α-alanine is converted to β-alanine. This reaction can occur in a cell or in vitro.

"Coding sequence" refers to that portion of a nucleic acid (e.g., a gene) that encodes an amino acid sequence of a protein.

"Naturally-occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides over a "comparison window" to identify and compare local regions of sequence similarity.

"Substantial identity" refers to a polynucleotide or polypeptide sequence that has at least 80 percent sequence identity, at least 85 percent sequence identity, about 89 to 95 percent sequence identity, and more usually at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some embodiments, residue positions which are not identical differ by conservative amino acid substitutions.

"Percentage of sequence identity" and "percentage homology" are used interchangeably herein to refer to comparisons among polynucleotides and polypeptides, which are determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman, 1981, *Adv. Appl. Math.* 2:482, by the homology alignment algorithm of Needleman and Wunsch, 1970, *J. Mol. Biol.* 48:443, by the search for similarity method of Pearson and Lipman, 1988, *Proc. Natl. Acad. Sci. USA* 85:2444, by computerized implementations of these algorithms (e.g., GAP, BESTFIT, FASTA, and TFASTA in the GCG Wisconsin Software Package), or by visual inspection (see generally, *Current Protocols in Molecular Biology*, F. M. Ausubel et al., eds., Greene Publishing Associates, Inc. and John Wiley & Sons, Inc., (1995 Supplement)). Examples of algorithms that are suitable for determining percent sequence identity and sequence similarity are the BLAST and BLAST 2.0 algorithms, which are described in Altschul et al., 1990, *J. Mol. Biol.* 215: 403-410 and Altschul et al., 1977, *Nucleic Acids Res.* 3389-3402, respectively. Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff, 1989, Proc Natl Acad Sci USA 89:10915). Exemplary determination of sequence alignment and % sequence identity can employ the BESTFIT or GAP programs in the GCG Wisconsin Software package (Accelrys, Madison Wis.), using default parameters provided, or the ClustalW multiple alignment program (available from the European Bioinformatics Institute, Cambridge, UK), using, in some embodiments, the parameters below.

For purposes of the present disclosure, in some embodiments, the degree of percent amino acid sequence identity can be obtained by ClustalW analysis (version W 1.8), counting the number of identical matches in the alignment and dividing such number of identical matches by the length of the reference sequence, and using the following default ClustalW parameters to achieve slow/accurate pairwise optimal alignments—Gap Open Penalty: 10; Gap Extension Penalty: 0.10; Protein weight matrix: Gonnet series; DNA weight matrix: IUB; Toggle Slow/Fast pairwise alignments=SLOW or FULL Alignment.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Recombinant" when used with reference to, e.g., a cell, nucleic acid, or polypeptide, refers to a material, or a material corresponding to the natural or native form of the material, that has been modified in a manner that would not otherwise exist in nature, or is identical thereto but produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

7.2 Engineered Alanine 2,3-aminomutases

The present disclosure is directed to engineered polypeptides that have improved (i.e., increased) alanine 2,3-aminomutase (AAM) activity relative to the wild-type polypeptide from *P. gingivalis* of SEQ ID NO: 2 and the mutated polypeptide of SEQ ID NO: 4. Because the polypeptide of SEQ ID NO: 4 has greater AAM activity than the wild-type enzyme from *P. gingivalis*, it is sufficient for the purposes herein to compare the AAM polypeptides of the present disclosure to the polypeptide of SEQ ID NO: 4. In some embodiments, the engineered polypeptides display an improved AAM activity than the reference AAM polypeptide of SEQ ID NO: 36, which has substantially increased AAM activity relative to SEQ ID NO: 4. In some embodiments, the engineered polypeptides may display an improved AAM activity than the reference polypeptide of SEQ ID NO:909.

In some embodiments herein, the engineered AAM with improved enzyme activity can be obtained by mutating the genetic material encoding the enzymes and identifying polynucleotides that express engineered enzymes with the improved activity. These non-naturally occurring AAMs can be generated by various well-known techniques, such as in vitro mutagenesis and/or directed evolution. In some embodiments, directed evolution is an attractive method for generating engineered enzymes because of the relative ease of generating mutations throughout the whole of the gene coding for the polypeptide, as well as providing the ability to take previously mutated polynucleotides and subjecting them to additional cycles of mutagenesis and/or recombination to obtain further improvements in a selected enzyme property. Subjecting the whole gene to mutagenesis can reduce the bias that may result from restricting the changes to a limited region of the gene. It can also enhance generation of enzymes affected in different enzyme properties since distantly spaced parts of the enzyme may play a role in various aspects of enzyme function. Mutagenesis and directed evolution techniques useful for the purposes herein are amply described in the literature: Ling et al., 1997, "Approaches to DNA mutagenesis: an overview," *Anal Biochem.* 254(2):157-78; Dale et al., 1996, "Oligonucleotide-directed random mutagenesis using the phosphorothioate method," *Methods Mol. Biol.* 57:369-74; Smith, 1985, "In vitro mutagenesis," 1985, *Ann Rev Genet.* 19:423-462; Botstein, et al., 1985, "Strategies and applications of in vitro mutagenesis," *Science* 229:1193-1201; Carter, 1986, "Site-directed mutagenesis," *Biochem* 1 237:1-7; Kramer et al., 1984, "Point Mismatch Repair," *Cell* 38:879-887; Wells et al., 1985, "Cassette mutagenesis: an efficient method for generation of multiple mutations at defined sites," *Gene* 34:315-323; Minshull et al., 1999, "Protein evolution by molecular breeding," *Curr Opin Chem Biol.* 3:284-290; Christians et al., 1999, "Directed evolution of thymidine kinase for AZT phosphorylation using DNA family shuffling, " *Nat Biotech.* 17:259-264; Crameri et al., 1998, "DNA shuffling of a family of genes from diverse species accelerates directed evolution," *Nature* 391:288-291; Crameri et al., 1997, "Molecular evolution of an arsenate detoxification pathway by DNA shuffling," *Nat Biotech.* 15:436-438; Zhang et al., 1997, "Directed evolution of an effective fructosidase from a galactosidase by DNA shuffling and screening," *Proc Natl Acad Sci USA* 94:45-4-4509; Crameri et al., 1996, "Improved green fluorescent protein by molecular evolution using DNA shuffling,' *Nat Biotech.* 14:315-319; Stemmer, 1994, "Rapid evolution of a protein in vitro by DNA shuffling," Nature 370:389-391; Stemmer, 1994, "DNA shuffling by random fragmentation and reassembly: In vitro recombination for molecular evolution," *Proc Natl Acad Sci USA* 91:10747-10751; WO 95/22625; WO 97/0078; WO 97/35966; WO 98/27230; WO 00/42651; WO 01/75767 and U.S. Pat. 6,537,746. All publications are incorporated herein by reference.

Without being bound by theory, the improvements in enzyme properties may arise from introduction of modifications into a polypeptide chain that may, in effect, perturbs the structure-function of the enzyme and/or interaction with another molecule (e.g., substrate). Some regions of the polypeptide may be critical to enzyme activity, for example amino acids involved in catalysis and substrate binding domains, such that small perturbations to these regions will have significant effects on enzyme function. Some amino acid residues may be at important positions for maintaining the secondary or tertiary structure of the enzyme, and thus also produce noticeable changes in enzyme properties when modified. Thus, in some embodiments, the number of modifications to the reference parent polypeptide that produces an improved AAM property may comprise one or more amino acids, 2 or more amino acids, 5 or more amino acids, 10 or more amino acids, or 20 or more amino acids, up to 10% of the total number of amino acids, up to 20% of the total number of amino acids, or up to 30% of the total number of amino acids making up the reference enzyme.

In some embodiments, improvements in enzyme activity can arise from substitutions at one amino acid residue, 2 or more amino acid residues, 5 or more amino acid residues, 10 or more amino acid residue, 15 or more amino acid residues, 20 or more amino acid residues, up to 10% of the total number of amino acids, up to 20% of the total number of amino acids, or up to 30% of the total number of amino acids making up the reference parent enzyme.

As will be apparent to the skilled artisan, an analysis of amino acid substitutions for a large number of engineered AAM polypeptides derived from SEQ ID NO:4 or another reference AAM polypeptide, shows that the substitutions recur at certain amino acid residues in the AAM polypeptide as well as a bias towards certain types of amino acids. This recurrence of substitutions at certain defined positions within the polypeptide may reflect the effect of amino acid residue on that particular enzyme property and its retention by the continued imposition of selection for the particular improved enzyme property. The recurrence of substitutions as well as the bias of the types of substituted amino acids can be grouped to describe the types of substitutions allowable for generating the improved AAM. Typically, genetically encoded amino acids can be grouped into the following classes based on their side chain properties:

"Hydrophilic Amino Acid or Residue" refers to an amino acid or residue having a side chain exhibiting a hydrophobicity of less than zero according to the normalized consensus hydrophobicity scale of Eisenberg et al., 1984, *J. Mol. Biol.* 179:125-142. Genetically encoded hydrophilic amino acids include L-Thr (T), L-Ser (S), L-His (H), L-Glu (E), L-Asn (N), L-Gln (Q), L-Asp (D), L-Lys (K) and L-Arg (R).

"Acidic Amino Acid or Residue" refers to a hydrophilic amino acid or residue having a side chain exhibiting a pK value of less than about 6 when the amino acid is included in a peptide or polypeptide. Acidic amino acids typically have negatively charged side chains at physiological pH due to loss of a hydrogen ion. Genetically encoded acidic amino acids include L-Glu (E) and L-Asp (D).

"Basic Amino Acid or Residue" refers to a hydrophilic amino acid or residue having a side chain exhibiting a pK value of greater than about 6 when the amino acid is included in a peptide or polypeptide. Basic amino acids typically have positively charged side chains at physiological pH due to association with hydronium ion. Genetically encoded basic amino acids include L-His (H), L-Arg (R) and L-Lys (K).

"Polar Amino Acid or Residue" refers to a hydrophilic amino acid or residue having a side chain that is uncharged at physiological pH, but which has at least one bond in which the pair of electrons shared in common by two atoms is held more closely by one of the atoms. Genetically encoded polar amino acids include L-Asn (N), L-Gln (Q), L-Ser (S) and L-Thr (T).

"Hydrophobic Amino Acid or Residue" refers to an amino acid or residue having a side chain exhibiting a hydrophobicity of greater than zero according to the normalized consensus hydrophobicity scale of Eisenberg et al., 1984, *J. Mol. Biol.* 179:125-142. Genetically encoded hydrophobic amino acids include L-Pro (P), L-Ile (I), L-Phe (F), L-Val (V), L-Leu (L), L-Trp (W), L-Met (M), L-Ala (A) and L-Tyr (Y).

"Aromatic Amino Acid or Residue" refers to a hydrophilic or hydrophobic amino acid or residue having a side chain that includes at least one aromatic or heteroaromatic ring. Genetically encoded aromatic amino acids include L-Phe (F), L-Tyr (Y) and L-Trp (W). Although owing to the pKa of its heteroaromatic nitrogen atom L-His (H) is classified above as a basic residue, as its side chain includes a heteroaromatic ring; it may also be classified as an aromatic residue.

"Non-polar Amino Acid or Residue" refers to a hydrophobic amino acid or residue having a side chain that is uncharged at physiological pH and which has bonds in which the pair of electrons shared in common by two atoms is generally held equally by each of the two atoms (i.e., the side chain is not polar). Genetically encoded non-polar amino acids include L-Leu (L), L-Val (V), L-Ile (I), L-Met (M) and L-Ala (A).

"Aliphatic Amino Acid or Residue" refers to a hydrophobic amino acid or residue having an aliphatic hydrocarbon side chain. Genetically encoded aliphatic amino acids include L-Ala (A), L-Val (V), L-Leu (L) and L-Ile (I).

The amino acid L-Cys (C) is unusual in that it can form disulfide bridges with other L-Cys (C) amino acids or other sulfanyl- or sulfhydryl-containing amino acids. The "cysteine-like residues" include cysteine and other amino acids that contain sulthydryl moieties that are available for formation of disulfide bridges. The ability of L-Cys (C) (and other amino acids with —SH containing side chains) to exist in a peptide in either the reduced free —SH or oxidized disulfide -bridged form affects whether L-Cys (C) contributes net hydrophobic or hydrophilic character to a peptide. While L-Cys (C) exhibits a hydrophobicity of 0.29 according to the normalized consensus scale of Eisenberg (Eisenberg et al., 1984, supra), it is to be understood that for purposes of the present disclosure L-Cys (C) is categorized as a polar hydrophilic amino acid, notwithstanding the general classifications defined above.

The amino acid Gly (G) is also unusual in that it bears no side chain on its α-carbon and, as a consequence, contributes only a peptide bond to a particular peptide sequence. Moreover, owing to the lack of a side chain, it is the only genetically-encoded amino acid having an achiral α-carbon. Although Gly (G) exhibits a hydrophobicity of 0.48 according to the normalized consensus scale of Eisenberg (Eisenberg et al., 1984, supra), for purposes of the present disclosure, Gly is categorized as an aliphatic amino acid or residue.

"Small Amino Acid or Residue" refers to an amino acid or residue having a side chain that is composed of a total three or fewer carbon and/or heteroatoms (excluding the α-carbon and hydrogens). The small amino acids or residues may be further categorized as aliphatic, non-polar, polar or acidic small amino acids or residues, in accordance with the above definitions. Genetically-encoded small amino acids include Gly, L-Ala (A), L-Val (V), L-Cys (C), L-Asn (N), L-Ser (S), L-Thr (T) and L-Asp (D).

"Hydroxyl-containing Amino Acid or Residue" refers to an amino acid containing a hydroxyl (—OH) moiety. Genetically-encoded hydroxyl-containing amino acids include L-Ser (S) L-Thr (T) and L-Tyr (Y).

As will be appreciated by those of skill in the art, the above-defined categories are not mutually exclusive. Indeed, the delineated category of small amino acids includes amino acids from all of the other delineated categories except the aromatic category. Thus, amino acids having side chains exhibiting two or more physico-chemical properties can be included in multiple categories. As a specific example, amino acid side chains having heteroaromatic moieties that include ionizable heteroatoms, such as His, may exhibit both aromatic properties and basic properties, and can therefore be included in both the aromatic and basic categories. The appropriate classification of any amino acid or residue will be apparent to those of skill in the art, especially in light of the detailed disclosure provided herein.

In some embodiments, the substitution in the engineered AAM may be a conservative substitution. The term "conservative amino acid substitution" refers to the interchangeability of residues having similar side chains, and thus typically involves substitution of the amino acid in the polypeptide with amino acids within the same or similar defined class of amino acids. By way of example and not limitation, an amino acid with an aliphatic side chain may be substituted with another aliphatic amino acid, e.g., alanine, valine, leucine, and isoleucine; an amino acid with hydroxyl side chain is substituted with another amino acid with a hydroxyl side chain, e.g., serine and threonine; an amino acid having aromatic side chains is substituted with another amino acid having an aromatic side chain, e.g., phenylalanine, tyrosine, tryptophan, and histidine; an amino acid with a basic side chain is substituted with another amino acid with a basic side chain, e.g., lysine, arginine, and histidine; an amino acid with an acidic side chain is substituted with another amino acid with an acidic side chain, e.g., aspartic acid or glutamic acid; and a hydrophobic or hydrophilic amino acid is replaced with another hydrophobic or hydrophilic amino acid, respectively. Amino acid substitutions, which do not generally alter the protein activity, are known in the art and are described, for example, Neurath and Hill, 1979, In The Proteins, Academic Press, New York. Commonly occurring conservative exchanges include, for example, Ala/Ser; Val/Ile; Asp/Glu; Thr/Ser; Ala/Gly; Ala/Thr, Ser/Asn; Ala/Val; Ser/Gly; Tyr/Phe; Ala/Pro; Lys/Arg; Asp/Asn; Leu/Ile, Leu/Val, Ala/Glu, and Asp/Gly as well as these in reverse.

In some embodiments, the substitution in the engineered AAM may be a non-conservative substitution. The term "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid. Thus, in various embodiments, the substitutions for generating an improved AAM can comprise conservative substitutions, non-conservative substitutions, as well as combinations of conservative and non-conservative substitutions.

In some embodiments, the improved engineered AAM enzymes can comprise deletions of the naturally occurring AAM polypeptides as well as deletions of other improved AAM polypeptides. The term "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered AAM enzyme. Deletions can be directed to the internal portions and/or terminal portions of the polypeptide. In various embodiments, the deletion can comprise a continuous segment or can be discontinuous.

In other embodiments, the improved engineered AAM enzymes comprise insertions of one or more amino acids to the reference AAM polypeptide, including insertions of one or more amino acids to other improved reference AAM polypeptides. Insertions can be in the internal portions of the polypeptide, or to the carboxy or amino terminus. Insertions as used herein include fusion proteins as is known in the art. The insertion can be a contiguous segment of amino acids or be separated by one or more of the amino acids in the reference parent polypeptide.

As described above, the various modifications introduced into the reference, parent polypeptide to generate an engineered AAM enzyme can be targeted to a specific property of the enzyme. Thus, in some embodiments, the improved property of the engineered AAM polypeptides is an increased enzymatic activity, typically represented by an increase in specific activity (e.g., product produced/time/weight protein) as compared to the reference AAM enzyme (e.g., the alanine 2,3-aminomutase activity of SEQ ID NO:4 of *Porphyromonas gingivalis*). Exemplary methods to determine enzyme activity are provided in the Examples. Any property relating to enzyme activity may be affected, including the classical enzyme properties of $K_M$, $V_{max}$ or $k_{cat}$, changes of which can lead to increased enzymatic activity. It is understood by the skilled artisan that the activity of any enzyme is diffusion limited such that the catalytic turnover rate cannot exceed the diffusion rate of the substrate, including any required cofactors. The theoretical maximum of the diffusion limit, or $k_{cat}/K_M$, is generally about $10^8$ to $10^9$ ($M^{-1}$ $s^{-1}$). Hence, any improvements in the enzyme activity AAM will have an upper limit related to the diffusion rate of the substrates acted on by the AAM enzyme. Alanine 2,3-aminomutase activity can be measured by any one of a number of assays used for measuring AAM activity, such as the assays described in the Examples herein. Comparisons of enzyme activities can be made using a defined preparation of enzyme and a defined assay under a set condition, as further described in detail herein. Generally, when lysates are compared, the numbers of cells and the amount of protein assayed are determined as well as use of identical expression systems, identical host cells to minimize variations in amount of enzyme produced by the host cells and present in the lysates.

In various embodiments, the improvements in enzyme activity can be from 1.5 times the enzymatic activity of the corresponding reference AAM enzyme, to as much as 2 times. 5 times, 10 times, 20 times, 25 times, 30 times, up to 50 times or more times enzymatic activity than the reference enzyme. In some embodiments, the engineered AAM can exhibit improved enzymatic activity in the range of 1.5 to 5 times; 1.5 to 10 times; 1.5 to 20 times; 1.5 to 30 times; 1.5 to 40 times, 1/5 to 50 times greater than that of the AAM enzyme from which it was derived. Thus, the AAM polypeptides of the present disclosure can have significantly enhanced AAM activity relative to the parent KAM polypeptide of SEQ ID NO: 4 from which they are ultimately derived. In some embodiments, the AAM polypeptides of the present disclosure have AAM activity that is from about 2 to about 30 times greater than the AAM polypeptide of SEQ ID NO: 4 as measured in the assay of Example 4. In other embodiments, the AAM polypeptides of the present disclosure have AAM activity that is from about 2 to about 10 times greater than the AAM polypeptide of SEQ ID NO: 36 as measured in the assay of Example 4.

In various embodiments, the engineered AAMs with improved enzyme activity comprise engineered polypeptides derived from *Porphyromonas gingivalis* alanine 2,3-aminomutase of SEQ ID NO:4. In some embodiments, the amino acid residues (identified herein as $X_n$, where n represents the position of the amino acid residue in the polypeptide chain) of the naturally occurring *Porphyromonas gingivalis* SEQ ID NO:2 or the AAM enzyme of SEQ ID NO:4 that can be modified to generate engineered polypeptides with improved enzyme activity are indicated below.

| Residue | Amino Acid |
|---|---|
| $X_2$ | hydroxyl containing amino acid |
| $X_4$ | basic or polar amino acid |
| $X_7$ | charged amino acid |
| $X_8$ | aromatic amino acid |
| $X_9$ | aromatic amino acid |
| $X_{10}$ | aromatic amino acid |
| $X_{15}$ | polar amino acid |
| $X_{16}$ | charged amino acid |
| $X_{17}$ | basic amino acid |
| $X_{19}$ | basic or polar amino acid |
| $X_{20}$ | acid or polar amino acid |
| $X_{22}$ | basic amino acid |
| $X_{26}$ | aliphatic amino acid |
| $X_{27}$ | basic or polar amino acid |
| $X_{29}$ | aliphatic amino acid |
| $X_{30}$ | charged amino acid |
| $X_{31}$ | aliphatic or hydroxyl containing amino acid |
| $X_{32}$ | aliphatic amino acid |
| $X_{33}$ | small or conformationally constrained amino acid |
| $X_{36}$ | acidic or small amino acid |
| $X_{37}$ | charge amino acid |
| $X_{40}$ | small amino acid |

-continued

| Residue | Amino Acid |
|---|---|
| $X_{41}$ | constrained amino acid |
| $X_{44}$ | aliphatic amino acid |
| $X_{47}$ | small or aliphatic amino acid |
| $X_{49}$ | aliphatic amino acid |
| $X_{50}$ | hydrophilic amino acid |
| $X_{51}$ | small or aliphatic amino acid |
| $X_{63}$ | aromatic amino acid |
| $X_{64}$ | hydrophilic amino acid |
| $X_{66}$ | hydrophilic amino acid |
| $X_{68}$ | hydrophobic amino acid |
| $X_{69}$ | polar amino acid |
| $X_{74}$ | basic amino acid |
| $X_{75}$ | acidic amino acid |
| $X_{77}$ | aliphatic amino acid |
| $X_{78}$ | hydrophilic amino acid |
| $X_{81}$ | small amino acid |
| $X_{82}$ | aliphatic amino acid |
| $X_{85}$ | basic amino acid |
| $X_{86}$ | hydrophilic amino acid |
| $X_{91}$ | small amino acid |
| $X_{95}$ | hydrophobic amino acid |
| $X_{98}$ | small amino acid |
| $X_{99}$ | aliphatic amino acid |
| $X_{106}$ | small amino acid |
| $X_{111}$ | hydrophobic amino acid |
| $X_{113}$ | polar amino acid |
| $X_{120}$ | hydrophobic amino acid |
| $X_{122}$ | small amino acid |
| $X_{130}$ | polar amino acid |
| $X_{132}$ | basic amino acid |
| $X_{135}$ | hydroxyl containing amino acid |
| $X_{137}$ | basic amino acid |
| $X_{138}$ | aromatic amino acid |
| $X_{139}$ | small amino acid |
| $X_{141}$ | basic or polar amino acid |
| $X_{142}$ | basic amino acid |
| $X_{145}$ | hydrophobic amino acid |
| $X_{149}$ | aliphatic amino acid |
| $X_{155}$ | aliphatic amino acid |
| $X_{156}$ | acidic amino acid |
| $X_{160}$ | hydroxyl containing amino acid |
| $X_{163}$ | small amino acid |
| $X_{164}$ | aliphatic amino acid |
| $X_{177}$ | aliphatic amino acid |
| $X_{178}$ | small amino acid; |
| $X_{180}$ | small amino acid |
| $X_{184}$ | hydrophobic or constrained amino acid |
| $X_{185}$ | hydroxyl containing amino acid |
| $X_{187}$ | charged amino acid |
| $X_{188}$ | basic amino acid |
| $X_{190}$ | polar amino acid |
| $X_{191}$ | small amino acid |
| $X_{192}$ | aliphatic amino acid |
| $X_{192}$ | small or aliphatic amino acid |
| $X_{197}$ | small amino acid |
| $X_{198}$ | aliphatic amino acid |
| $X_{200}$ | aliphatic amino acid |
| $X_{202}$ | hydroxyl containing amino acid |
| $X_{204}$ | small amino acid |
| $X_{206}$ | aliphatic amino acid |
| $X_{212}$ | non-polar amino acid |
| $X_{215}$ | basic amino acid |
| $X_{217}$ | aliphatic amino acid |
| $X_{218}$ | small amino acid |
| $X_{222}$ | basic amino acid |
| $X_{223}$ | aromatic amino acid |
| $X_{226}$ | aliphatic amino acid |
| $X_{228}$ | hydrophobic amino acid |
| $X_{230}$ | small amino acid |
| $X_{232}$ | small amino acid |
| $X_{238}$ | aliphatic amino acid |
| $X_{244}$ | small amino acid |
| $X_{247}$ | small amino acid |
| $X_{248}$ | basic or hydrophobic amino acid |
| $X_{249}$ | hydrophobic amino acid |
| $X_{250}$ | hydroxyl containing or aliphatic amino acid |

| Residue | Amino Acid |
| --- | --- |
| $X_{251}$ | aromatic or hydroxyl containing amino acid |
| $X_{252}$ | hydroxyl containing amino acid |
| $X_{254}$ | hydrophobic amino acid |
| $X_{260}$ | hydroxyl containing amino acid |
| $X_{266}$ | aliphatic amino acid |
| $X_{268}$ | small amino acid |
| $X_{275}$ | basic or small amino acid |
| $X_{278}$ | aromatic amino acid |
| $X_{279}$ | basic amino acid |
| $X_{282}$ | charged amino acid |
| $X_{283}$ | aliphatic amino acid |
| $X_{290}$ | hydrophobic amino acid |
| $X_{292}$ | aliphatic amino acid |
| $X_{297}$ | hydrophobic amino acid |
| $X_{299}$ | hydrophobic amino acid |
| $X_{300}$ | charged or polar amino acid |
| $X_{302}$ | hydrophobic amino acid |
| $X_{303}$ | basic amino acid |
| $X_{310}$ | aliphatic or hydroxyl containing amino acid |
| $X_{311}$ | small amino acid |
| $X_{313}$ | polar or aliphatic amino acid |
| $X_{315}$ | hydroxyl containing amino acid |
| $X_{321}$ | aliphatic amino acid |
| $X_{323}$ | aromatic amino acid |
| $X_{328}$ | aromatic amino acid |
| $X_{331}$ | charged or small amino acid |
| $X_{333}$ | aliphatic amino acid |
| $X_{336}$ | aliphatic amino acid |
| $X_{339}$ | aliphatic amino acid |
| $X_{341}$ | hydrophobic amino acid |
| $X_{342}$ | hydrophobic amino acid |
| $X_{347}$ | aliphatic amino acid |
| $X_{353}$ | basic amino acid |
| $X_{355}$ | aliphatic amino acid |
| $X_{359}$ | aromatic amino acid |
| $X_{362}$ | aliphatic amino acid |
| $X_{363}$ | hydroxyl containing amino acid |
| $X_{367}$ | small amino acid |
| $X_{368}$ | small amino acid |
| $X_{370}$ | acidic amino acid |
| $X_{371}$ | charge or polar amino acid |
| $X_{372}$ | charged or polar amino acid |
| $X_{374}$ | small amino acid |
| $X_{377}$ | small amino acid |
| $X_{379}$ | small amino acid |
| $X_{381}$ | polar amino acid |
| $X_{382}$ | basic amino acid |
| $X_{383}$ | aliphatic amino acid |
| $X_{384}$ | acidic amino acid |
| $X_{385}$ | charged amino acid |
| $X_{386}$ | basic or polar amino acid |
| $X_{387}$ | basic or small amino acid residue |
| $X_{388}$ | aliphatic amino acid |
| $X_{390}$ | aliphatic amino acid |
| $X_{392}$ | charged or polar amino acid |
| $X_{394}$ | aliphatic amino acid |
| $X_{395}$ | acidic or polar amino acid |
| $X_{396}$ | hydroxyl containing amino acid |
| $X_{397}$ | basic or polar amino acid |
| $X_{398}$ | basic or polar amino acid |
| $X_{399}$ | hydrophobic amino acid |
| $X_{400}$ | aliphatic amino acid |
| $X_{401}$ | hydrophobic amino acid |
| $X_{402}$ | small amino acid |
| $X_{403}$ | hydrophobic or small amino acid |
| $X_{404}$ | hydropobic amino acid |
| $X_{405}$ | acidic or polar amino acid |
| $X_{406}$ | hydroxyl containing amino acid |
| $X_{407}$ | acidic or polar amino acid |
| $X_{409}$ | charged or hydrophobic amino acid |
| $X_{410}$ | acidic amino acid |
| $X_{412}$ | basic amino acid |
| $X_{413}$ | hydrophobic or small amino acid |
| $X_{414}$ | aliphatic or small amino acid |
| $X_{415}$ | charged amino acid |
| $X_{416}$ | aliphatic amino acid |

In some embodiments, the amino acid residues can be substituted with one or more of the specific amino acid residues below to obtain AAMs with improved enzymatic activity:

| Residue | Amino Acid |
| --- | --- |
| $X_2$ | S or T |
| $X_4$ | R, C or N |
| $X_7$ | E |
| $X_8$ | H |
| $X_9$ | F |
| $X_{10}$ | W |
| $X_{15}$ | N |
| $X_{16}$ | K |
| $X_{17}$ | K |
| $X_{19}$ | C or H |
| $X_{20}$ | N |
| $X_{22}$ | R |
| $X_{26}$ | I or T |
| $X_{27}$ | H |
| $X_{29}$ | V |
| $X_{30}$ | R |
| $X_{31}$ | A or S |
| $X_{32}$ | V |
| $X_{33}$ | P or G |
| $X_{36}$ | E or A |
| $X_{37}$ | E |
| $X_{40}$ | A |
| $X_{41}$ | P |
| $X_{44}$ | G |
| $X_{47}$ | G |
| $X_{49}$ | I |
| $X_{50}$ | Q |
| $X_{51}$ | G |
| $X_{63}$ | H |
| $X_{64}$ | C |
| $X_{66}$ | C |
| $X_{68}$ | L or M |
| $X_{69}$ | N |
| $X_{74}$ | K or H |
| $X_{75}$ | D |
| $X_{77}$ | V |
| $X_{78}$ | C |
| $X_{81}$ | T |
| $X_{82}$ | V |
| $X_{85}$ | R or K |
| $X_{86}$ | R |
| $X_{91}$ | S |
| $X_{95}$ | M or V |
| $X_{98}$ | S |
| $X_{99}$ | V |
| $X_{106}$ | S |
| $X_{111}$ | P |
| $X_{113}$ | C |
| $X_{120}$ | L |
| $X_{122}$ | T or V |
| $X_{130}$ | S |
| $X_{132}$ | R |
| $X_{135}$ | S |
| $X_{137}$ | H |
| $X_{138}$ | Y |
| $X_{139}$ | T |
| $X_{141}$ | R |
| $X_{142}$ | R |
| $X_{145}$ | P |
| $X_{149}$ | V |
| $X_{155}$ | V |
| $X_{156}$ | E |

| Residue | Amino Acid |
| --- | --- |
| $X_{160}$ | T |
| $X_{163}$ | A |
| $X_{164}$ | I |
| $X_{177}$ | L |
| $X_{178}$ | G or C |
| $X_{180}$ | G |
| $X_{184}$ | C |
| $X_{185}$ | T |
| $X_{187}$ | R or E |
| $X_{188}$ | H |
| $X_{190}$ | C |
| $X_{191}$ | G |
| $X_{192}$ | I |
| $X_{196}$ | A or G |
| $X_{197}$ | T or V |
| $X_{198}$ | I |
| $X_{200}$ | V |
| $X_{202}$ | T |
| $X_{204}$ | A |
| $X_{206}$ | I or A |
| $X_{212}$ | M |
| $X_{215}$ | H or R |
| $X_{217}$ | A |
| $X_{218}$ | G |
| $X_{222}$ | R |
| $X_{223}$ | H |
| $X_{226}$ | A |
| $X_{228}$ | V |
| $X_{230}$ | A |
| $X_{232}$ | S |
| $X_{238}$ | I |
| $X_{244}$ | G or V |
| $X_{247}$ | G |
| $X_{248}$ | G, K, or M |
| $X_{249}$ | I |
| $X_{250}$ | T or V |
| $X_{251}$ | Y or S |
| $X_{252}$ | T |
| $X_{254}$ | V |
| $X_{260}$ | S |
| $X_{266}$ | V |
| $X_{268}$ | G |
| $X_{275}$ | G or K |
| $X_{278}$ | Y |
| $X_{279}$ | K |
| $X_{282}$ | N |
| $X_{283}$ | I or V |
| $X_{290}$ | M or V |
| $X_{292}$ | A |
| $X_{297}$ | M or F |
| $X_{299}$ | M |
| $X_{300}$ | R or S |
| $X_{302}$ | L |
| $X_{303}$ | H |
| $X_{310}$ | T or V |
| $X_{311}$ | G |
| $X_{313}$ | N, V, S, or T |
| $X_{315}$ | S |
| $X_{321}$ | L |
| $X_{323}$ | F |
| $X_{328}$ | Y |
| $X_{331}$ | H |
| $X_{333}$ | A |
| $X_{336}$ | A |
| $X_{339}$ | V |
| $X_{341}$ | L, I, or A |
| $X_{342}$ | A |
| $X_{347}$ | I |
| $X_{353}$ | R |
| $X_{355}$ | I |
| $X_{359}$ | F |
| $X_{362}$ | A or I |
| $X_{363}$ | T |
| $X_{367}$ | A |
| $X_{368}$ | G |
| $X_{370}$ | D |
| $X_{371}$ | D |
| $X_{372}$ | C |
| $X_{374}$ | G |
| $X_{377}$ | G |
| $X_{379}$ | V |
| $X_{381}$ | S |
| $X_{382}$ | H |
| $X_{383}$ | V |
| $X_{384}$ | D or G |
| $X_{385}$ | E |
| $X_{386}$ | Q |
| $X_{387}$ | R or A |
| $X_{388}$ | I |
| $X_{390}$ | I |
| $X_{392}$ | T or E |
| $X_{394}$ | L |
| $X_{395}$ | E or S |
| $X_{396}$ | S |
| $X_{397}$ | R |
| $X_{398}$ | R |
| $X_{399}$ | M |
| $X_{400}$ | V |
| $X_{401}$ | L or M |
| $X_{402}$ | V |
| $X_{403}$ | S, G, I, L, M, or T |
| $X_{404}$ | P |
| $X_{405}$ | N |
| $X_{406}$ | S |
| $X_{407}$ | E |
| $X_{409}$ | E or M |
| $X_{410}$ | E or D |
| $X_{412}$ | R |
| $X_{413}$ | L, G, or S |
| $X_{414}$ | G or V |
| $X_{415}$ | E or R |
| $X_{416}$ | A |

In some embodiments, the engineered AAMs with improved enzyme activity can have modifications to a subset of the residues above. In some of these embodiments, the amino acid residues of the naturally occurring AAM polypeptide of SEQ ID NO:2 or the AAM polypeptide of SEQ ID NO:4 that can be substituted are as follows.

| Residue | Amino Acid |
| --- | --- |
| $X_8$ | aromatic amino acid |
| $X_{20}$ | acid or polar amino acid |
| $X_{26}$ | aliphatic amino acid |
| $X_{33}$ | small or conformationally constrained amino acid |
| $X_{36}$ | acidic or small amino acid |
| $X_{51}$ | small or aliphatic amino acid |
| $X_{74}$ | basic amino acid; |
| $X_{85}$ | basic amino acid |
| $X_{86}$ | hydrophilic amino acid |
| $X_{91}$ | small amino acid |
| $X_{95}$ | hydrophobic amino acid |
| $X_{99}$ | aliphatic amino acid |
| $X_{111}$ | hydrophobic amino acid |
| $X_{130}$ | polar amino acid |
| $X_{135}$ | hydroxyl containing amino acid |
| $X_{138}$ | aromatic amino acid |
| $X_{139}$ | small amino acid |
| $X_{141}$ | basic or polar amino acid |
| $X_{142}$ | basic amino acid |
| $X_{149}$ | aliphatic amino acid |
| $X_{155}$ | aliphatic amino acid |
| $X_{156}$ | acidic amino acid |
| $X_{163}$ | small amino acid |
| $X_{192}$ | aliphatic amino acid |
| $X_{202}$ | hydroxyl containing amino acid |
| $X_{204}$ | small amino acid |
| $X_{244}$ | small amino acid |
| $X_{247}$ | small amino acid |

-continued

| Residue | Amino Acid |
|---|---|
| $X_{251}$ | aromatic or hydroxyl containing amino acid |
| $X_{275}$ | basic or small amino acid |
| $X_{283}$ | aliphatic amino acid |
| $X_{292}$ | aliphatic amino acid |
| $X_{297}$ | hydrophobic amino acid |
| $X_{300}$ | charged or polar amino acid |
| $X_{313}$ | polar or aliphatic amino acid |
| $X_{315}$ | hydroxyl containing amino acid |
| $X_{331}$ | charged or small amino acid |
| $X_{339}$ | aliphatic amino acid |
| $X_{341}$ | hydrophobic amino acid |
| $X_{342}$ | hydrophobic amino acid |
| $X_{353}$ | basic amino acid |
| $X_{355}$ | aliphatic amino acid |
| $X_{362}$ | aliphatic amino acid |
| $X_{363}$ | hydroxyl containing amino acid |
| $X_{371}$ | charge or polar amino acid |
| $X_{379}$ | small amino acid |
| $X_{383}$ | aliphatic amino acid |
| $X_{384}$ | acidic amino acid |
| $X_{385}$ | charged amino acid |
| $X_{387}$ | basic or small amino acid residue |
| $X_{392}$ | charged or polar amino acid |
| $X_{395}$ | acidic or polar amino acid |
| $X_{399}$ | hydrophobic amino acid |
| $X_{401}$ | hydrophobic amino acid |
| $X_{404}$ | hydropobic amino acid |
| $X_{410}$ | acidic amino acid |
| $X_{412}$ | basic amino acid |
| $X_{413}$ | hydrophobic or small amino acid |

In some embodiments, the subset of the amino acid residues above can be substituted with one or more of the specific amino acid residues below to obtain AAMs with improved enzymatic activity:

| Residue | Amino Acid |
|---|---|
| $X_8$ | H |
| $X_{20}$ | N |
| $X_{26}$ | I |
| $X_{33}$ | P |
| $X_{36}$ | E |
| $X_{51}$ | G |
| $X_{74}$ | K |
| $X_{85}$ | R or K |
| $X_{86}$ | R |
| $X_{91}$ | S |
| $X_{95}$ | M |
| $X_{99}$ | V |
| $X_{111}$ | P |
| $X_{130}$ | S |
| $X_{135}$ | S |
| $X_{138}$ | Y |
| $X_{139}$ | T |
| $X_{141}$ | R |
| $X_{142}$ | R |
| $X_{149}$ | V |
| $X_{156}$ | E |
| $X_{163}$ | A |
| $X_{192}$ | I |
| $X_{202}$ | T |
| $X_{204}$ | A |
| $X_{244}$ | V |
| $X_{247}$ | G |
| $X_{251}$ | Y or S |
| $X_{275}$ | G |
| $X_{283}$ | I or V |
| $X_{292}$ | A |
| $X_{297}$ | M or F |
| $X_{300}$ | R |
| $X_{313}$ | T |
| $X_{315}$ | S |
| $X_{331}$ | H |
| $X_{339}$ | V |
| $X_{341}$ | L or I |
| $X_{342}$ | A |
| $X_{353}$ | R |
| $X_{355}$ | I |
| $X_{362}$ | A |
| $X_{363}$ | T |
| $X_{371}$ | D |
| $X_{379}$ | V |
| $X_{383}$ | V |
| $X_{384}$ | D |
| $X_{385}$ | E |
| $X_{387}$ | R |
| $X_{392}$ | T |
| $X_{395}$ | E |
| $X_{399}$ | M |
| $X_{401}$ | L |
| $X_{404}$ | P |
| $X_{410}$ | E |
| $X_{412}$ | R |
| $X_{413}$ | L or S |
| $X_{341}$ | L or I |
| $X_{342}$ | A |
| $X_{353}$ | R |
| $X_{355}$ | I |
| $X_{362}$ | A |
| $X_{363}$ | T |
| $X_{371}$ | D |
| $X_{379}$ | V |
| $X_{383}$ | V |
| $X_{384}$ | D |
| $X_{385}$ | E |
| $X_{387}$ | R |
| $X_{392}$ | T |
| $X_{395}$ | E |
| $X_{399}$ | M |
| $X_{401}$ | L |
| $X_{404}$ | P |
| $X_{410}$ | E |
| $X_{412}$ | R |
| $X_{413}$ | L or S |

In some embodiments, the engineered AAM with improved enzyme activity can have modifications to a subset of the residues above based on a reference polypeptide of another engineered AAM. Thus, in some embodiments, the modifications can be based on the reference engineered AAM of SEQ ID NO:909, with the residues that can be substituted with reference to SEQ ID NO:4 as indicated below.

| Residue | Amino Acid |
|---|---|
| $X_4$ | basic or polar amino acid |
| $X_7$ | charged amino acid |
| $X_{15}$ | polar amino acid |
| $X_{19}$ | basic or polar amino acid |
| $X_{20}$ | acid or polar amino acid |
| $X_{26}$ | aliphatic amino acid |
| $X_{33}$ | small or conformationally constrained amino acid |
| $X_{40}$ | small amino acid |
| $X_{41}$ | contrained amino acid |
| $X_{44}$ | aliphatic amino acid; |
| $X_{47}$ | small or aliphatic amino acid |
| $X_{50}$ | hydrophilic amino acid |
| $X_{51}$ | small or aliphatic amino acid; |
| $X_{63}$ | aromatic amino acid |
| $X_{64}$ | hydrophilic amino acid; |
| $X_{66}$ | hydrophilic amino acid |
| $X_{68}$ | hydrophobic amino acid |
| $X_{69}$ | polar amino acid |

-continued

| Residue | Amino Acid |
|---|---|
| X₇₄ | basic amino acid |
| X₇₅ | acidic amino acid |
| X₈₁ | small amino acid |
| X₈₅ | basic amino acid |
| X₉₁ | small amino acid |
| X₉₅ | hydrophobic amino acid |
| X₉₈ | small amino acid |
| X₉₉ | aliphatic amino acid |
| X₁₁₃ | polar amino acid |
| X₁₃₀ | polar amino acid |
| X₁₃₂ | basic amino acid |
| X₁₃₅ | hydroxyl containing amino acid |
| X₁₃₇ | basic amino acid |
| X₁₄₁ | basic or polar amino acid |
| X₁₅₅ | aliphatic amino acid |
| X₁₅₆ | acidic amino acid |
| X₁₆₃ | small amino acid |
| X₁₇₈ | small amino acid; |
| X₁₈₀ | small amino acid |
| X₁₈₄ | hydrophobic or constrained amino acid |
| X₁₈₅ | hydroxyl containing amino acid |
| X₁₈₇ | charged amino acid |
| X₁₈₈ | basic amino acid |
| X₁₈₀ | small amino acid |
| X₁₈₄ | hydrophobic or constrained amino acid |
| X₁₈₅ | hydroxyl containing amino acid |
| X₁₉₀ | polar amino acid |
| X₁₉₁ | small amino acid |
| X₁₉₇ | small amino acid |
| X₂₀₂ | hydroxyl containing amino acid |
| X₂₀₆ | aliphatic amino acid |
| X₂₁₂ | non-polar amino acid |
| X₂₁₈ | small amino acid |
| X₂₂₆ | aliphatic amino acid |
| X₂₃₀ | small amino acid |
| X₂₄₄ | small amino acid |
| X₂₄₇ | small amino acid |
| X₂₄₈ | basic or hydrophobic amino acid |
| X₂₄₉ | hydrophobic amino acid |
| X₂₅₀ | hydroxyl containing or aliphatic amino acid |
| X₂₅₂ | hydroxyl containing amino acid |
| X₂₆₈ | small amino acid |
| X₂₇₈ | aromatic amino acid |
| X₂₈₃ | aliphatic amino acid |
| X₂₉₇ | hydrophobic amino acid |
| X₂₉₉ | hydrophobic amino acid |
| X₃₀₃ | basic amino acid |
| X₃₁₀ | aliphatic or hydroxyl containing amino acid |
| X₃₁₁ | small amino acid |
| X₃₁₃ | polar or aliphatic amino acid |
| X₃₁₅ | hydroxyl containing amino acid |
| X₃₂₁ | aliphatic amino acid |
| X₃₂₃ | aromatic amino acid |
| X₃₃₆ | aliphatic amino acid |
| X₃₄₁ | hydrophobic amino acid |
| X₃₅₅ | aliphatic amino acid |
| X₃₆₂ | aliphatic amino acid |
| X₃₆₃ | hydroxyl containing amino acid |
| X₃₆₇ | small amino acid |
| X₃₆₈ | small amino acid |
| X₃₇₂ | charged or polar amino acid |
| X₃₈₅ | charged amino acid |
| X₃₉₇ | basic or polar amino acid |
| X₃₉₈ | basic or polar amino acid |
| X₄₀₀ | aliphatic amino acid |
| X₄₀₃ | hydrophobic or small amino acid |
| X₄₁₃ | hydrophobic or small amino acid |

In some embodiments, the substitutions based on the reference sequence of SEQ ID NO:909 can be selected from one ore more of the specific amino acids as follows:

| Residue | Amino Acid |
|---|---|
| X₄ | R |
| X₇ | E |
| X₁₅ | N |
| X₁₉ | C |
| X₂₀ | N |
| X₂₆ | I or T |
| X₃₃ | P or G |
| X₄₀ | A |
| X₄₁ | P |
| X₄₄ | G |
| X₄₇ | G |
| X₅₀ | Q |
| X₅₁ | G |
| X₆₃ | H |
| X₆₄ | C |
| X₆₆ | C |
| X₆₈ | L or M; |
| X₆₉ | N |
| X₇₄ | K or H |
| X₈₁ | T |
| X₈₅ | R or K |
| X₉₁ | S |
| X₉₅ | M or V |
| X₉₈ | S |
| X₉₉ | V |
| X₁₁₃ | C |
| X₁₃₀ | S |
| X₁₃₂ | R |
| X₁₃₅ | S |
| X₁₃₇ | H |
| X₁₄₁ | R |
| X₁₅₅ | V |
| X₁₆₃ | A |
| X₁₇₈ | G or C |
| X₁₈₄ | C |
| X₁₈₅ | T |
| X₁₈₇ | R or E |
| X₁₉₀ | C |
| X₁₉₇ | T or V |
| X₂₀₂ | T |
| X₂₀₆ | I or A |
| X₂₁₂ | M |
| X₂₁₈ | G |
| X₂₂₆ | A |
| X₂₃₀ | A |
| X₂₄₄ | G or V |
| X₂₄₇ | G |
| X₂₄₈ | G, K, or M |
| X₂₄₉ | I |
| X₂₅₀ | T or V |
| X₂₅₂ | T |
| X₂₆₈ | G |
| X₂₇₈ | Y |
| X₂₈₃ | I or V |
| X₂₉₇ | M or F |
| X₂₉₉ | M |
| X₃₀₃ | H |
| X₃₁₁ | G |
| X₃₁₃ | N, V, S, or T |
| X₃₂₁ | L |
| X₃₂₃ | F |
| X₃₃₆ | A |
| X₃₄₁ | L, I, or A |
| X₃₅₅ | I |
| X₃₆₂ | A or I |
| X₃₆₃ | T |
| X₃₆₇ | A |
| X₃₆₈ | G |
| X₃₇₂ | C |
| X₃₈₅ | E |
| X₃₉₇ | R |
| X₃₉₈ | R |
| X₄₀₀ | V; |
| X₄₀₃ | S, G, or T |
| X₄₁₃ | L, G, or S |

In other embodiments, the subset of modifications to the engineered alanine 2,3-aminomutase of SEQ ID NO:909 can include the following substitutions with respect to SEQ ID NO:4:

| Residue | Amino Acid |
| --- | --- |
| $X_2$ | hydroxyl containing amino acid |
| $X_4$ | basic or polar amino acid |
| $X_8$ | aromatic amino acid |
| $X_9$ | aromatic amino acid |
| $X_{10}$ | aromatic amino acid |
| $X_{16}$ | charged amino acid |
| $X_{17}$ | basic amino acid |
| $X_{19}$ | basic or polar amino acid |
| $X_{22}$ | basic amino acid |
| $X_{29}$ | aliphatic amino acid |
| $X_{30}$ | charged amino acid |
| $X_{31}$ | aliphatic or hydroxyl containing amino acid |
| $X_{32}$ | aliphatic amino acid |
| $X_{36}$ | acidic or small amino acid |
| $X_{37}$ | charge amino acid |
| $X_{49}$ | aliphatic amino acid |
| $X_{68}$ | hydrophobic amino acid |
| $X_{75}$ | acidic amino acid |
| $X_{77}$ | aliphatic amino acid |
| $X_{78}$ | hydrophilic amino acid |
| $X_{82}$ | aliphatic amino acid |
| $X_{85}$ | basic amino acid |
| $X_{86}$ | hydrophilic amino acid |
| $X_{106}$ | small amino acid |
| $X_{120}$ | hydrophobic amino acid |
| $X_{122}$ | small amino acid |
| $X_{142}$ | basic amino acid |
| $X_{145}$ | hydrophobic amino acid |
| $X_{149}$ | aliphatic amino acid |
| $X_{160}$ | hydroxyl containing amino acid |
| $X_{164}$ | aliphatic amino acid |
| $X_{177}$ | aliphatic amino acid |
| $X_{178}$ | small amino acid |
| $X_{180}$ | small amino acid |
| $X_{187}$ | charged amino acid |
| $X_{191}$ | small amino acid |
| $X_{192}$ | aliphatic amino acid |
| $X_{196}$ | small or aliphatic amino acid |
| $X_{197}$ | small amino acid |
| $X_{198}$ | aliphatic amino acid |
| $X_{200}$ | aliphatic amino acid |
| $X_{204}$ | small amino acid |
| $X_{206}$ | aliphatic amino acid |
| $X_{215}$ | basic amino acid |
| $X_{217}$ | aliphatic amino acid |
| $X_{222}$ | basic amino acid |
| $X_{223}$ | aromatic amino acid |
| $X_{228}$ | hydrophobic amino acid |
| $X_{232}$ | small amino acid |
| $X_{238}$ | aliphatic amino acid |
| $X_{248}$ | basic or hydrophobic amino acid |
| $X_{250}$ | hydroxyl containing or aliphatic amino acid |
| $X_{251}$ | aromatic or hydroxyl containing amino acid |
| $X_{254}$ | hydrophobic amino acid |
| $X_{260}$ | hydroxyl containing amino acid |
| $X_{266}$ | aliphatic amino acid |
| $X_{275}$ | basic or small amino acid |
| $X_{279}$ | basic amino acid |
| $X_{282}$ | charged amino acid |
| $X_{283}$ | aliphatic amino acid |
| $X_{290}$ | hydrophobic amino acid |
| $X_{300}$ | charged or polar amino acid |
| $X_{302}$ | hydrophobic amino acid |
| $X_{310}$ | aliphatic or hydroxyl containing amino acid |
| $X_{313}$ | polar or aliphatic amino acid |
| $X_{315}$ | hydroxyl containing amino acid |
| $X_{328}$ | aromatic amino acid |
| $X_{333}$ | aliphatic amino acid |
| $X_{339}$ | aliphatic amino acid |
| $X_{341}$ | hydrophobic amino acid |
| $X_{342}$ | hydrophobic amino acid |
| $X_{347}$ | aliphatic amino acid |
| $X_{359}$ | aromatic amino acid |
| $X_{362}$ | aliphatic amino acid |
| $X_{370}$ | acidic amino acid |
| $X_{374}$ | small amino acid |
| $X_{377}$ | small amino acid |
| $X_{379}$ | small amino acid |
| $X_{381}$ | polar amino acid |
| $X_{382}$ | basic amino acid |
| $X_{383}$ | aliphatic amino acid |
| $X_{384}$ | acidic amino acid |
| $X_{386}$ | basic or polar amino acid |
| $X_{387}$ | basic or small amino acid residue |
| $X_{388}$ | aliphatic amino acid |
| $X_{390}$ | aliphatic amino acid |
| $X_{392}$ | charged or polar amino acid |
| $X_{394}$ | aliphatic amino acid |
| $X_{395}$ | acidic or polar amino acid |
| $X_{396}$ | hydroxyl containing amino acid |
| $X_{401}$ | hydrophobic amino acid |
| $X_{402}$ | small amino acid |
| $X_{403}$ | hydrophobic or small amino acid |
| $X_{404}$ | hydropobic amino acid |
| $X_{405}$ | acidic or polar amino acid |
| $X_{406}$ | hydroxyl containing amino acid |
| $X_{407}$ | acidic or polar amino acid |
| $X_{409}$ | charged or hydrophobic amino acid |
| $X_{410}$ | acidic amino acid |
| $X_{412}$ | basic amino acid |
| $X_{413}$ | hydrophobic or small amino acid |
| $X_{414}$ | aliphatic or small amino acid |
| $X_{415}$ | charged amino acid |
| $X_{416}$ | aliphatic amino acid |

In some embodiments, the subset of the amino acid residues that can be modified based on the reference AAM polypeptide of SEQ ID NO:909 include substitutions with one or more specific amino acids below with respect to SEQ ID NO:4:

| Residue | Amino Acid |
| --- | --- |
| $X_2$ | S or T |
| $X_4$ | R, C or N |
| $X_8$ | H |
| $X_9$ | F |
| $X_{10}$ | W |
| $X_{16}$ | K |
| $X_{17}$ | K |
| $X_{19}$ | C or H |
| $X_{22}$ | R |
| $X_{29}$ | V |
| $X_{30}$ | R |
| $X_{31}$ | A or S |
| $X_{32}$ | V |
| $X_{36}$ | E or A |
| $X_{37}$ | E |
| $X_{49}$ | I |
| $X_{68}$ | L or M |
| $X_{75}$ | D |
| $X_{77}$ | V |
| $X_{78}$ | C |
| $X_{82}$ | V |
| $X_{85}$ | R or K |
| $X_{86}$ | R |
| $X_{106}$ | S |
| $X_{120}$ | L |
| $X_{122}$ | T or V |
| $X_{142}$ | R |

| Residue | Amino Acid |
|---|---|
| $X_{145}$ | |
| $X_{149}$ | V |
| $X_{156}$ | E |
| $X_{160}$ | T |
| $X_{164}$ | I |
| $X_{177}$ | L |
| $X_{178}$ | G or C |
| $X_{180}$ | G |
| $X_{187}$ | R or E |
| $X_{191}$ | G |
| $X_{192}$ | I |
| $X_{196}$ | A or G |
| $X_{197}$ | T or V |
| $X_{198}$ | I |
| $X_{200}$ | V |
| $X_{204}$ | A |
| $X_{206}$ | I or A |
| $X_{215}$ | H or R |
| $X_{217}$ | A |
| $X_{222}$ | R |
| $X_{223}$ | H |
| $X_{228}$ | V |
| $X_{232}$ | S |
| $X_{238}$ | I |
| $X_{248}$ | G, K, or M |
| $X_{250}$ | T or V |
| $X_{251}$ | Y or S |
| $X_{254}$ | V |
| $X_{260}$ | S |
| $X_{266}$ | V |
| $X_{275}$ | G or K |
| $X_{279}$ | K |
| $X_{282}$ | N |
| $X_{283}$ | I or V |
| $X_{290}$ | M or V |
| $X_{300}$ | R or S |
| $X_{302}$ | L |
| $X_{310}$ | T or V |
| $X_{313}$ | N, V, S, or T |
| $X_{315}$ | S |
| $X_{321}$ | L |
| $X_{328}$ | Y |
| $X_{333}$ | A |
| $X_{339}$ | V |
| $X_{341}$ | L, I, or A |
| $X_{342}$ | A |
| $X_{347}$ | I |
| $X_{359}$ | F |
| $X_{362}$ | A or I |
| $X_{370}$ | D |
| $X_{374}$ | G |
| $X_{377}$ | G |
| $X_{379}$ | V |
| $X_{381}$ | S |
| $X_{382}$ | H |
| $X_{383}$ | V |
| $X_{384}$ | D or G |
| $X_{386}$ | Q |
| $X_{387}$ | R or A |
| $X_{388}$ | I |
| $X_{390}$ | I |
| $X_{392}$ | T or E |
| $X_{394}$ | L |
| $X_{395}$ | E or S |
| $X_{396}$ | S |
| $X_{401}$ | L or M |
| $X_{402}$ | V |
| $X_{403}$ | S, G, I, L, M, or T |
| $X_{404}$ | P |
| $X_{405}$ | N |
| $X_{406}$ | S |
| $X_{407}$ | E |
| $X_{409}$ | E or M |
| $X_{410}$ | E or D |
| $X_{412}$ | R |
| $X_{413}$ | L, G, or S |
| $X_{414}$ | G or V |
| $X_{415}$ | E or R |
| $X_{416}$ | A |

It is to be understood that the forgoing description is not to be limiting but is presented to provide guidance to the skilled artisan for identifying the amino acid residue positions for modification and the type of amino acid substitutions that can be used to obtain the engineered AAM enzymes of the present disclosure.

To illustrate the generation of engineered AAM enzymes, the AAM polynucleotide of SEQ ID NO:3 was subjected to mutagenesis by directed evolution, and the mutated polynucleotides expressed and then screened in accordance with the protocol described in Example 4 to identify those having improved AAM activity. In the process of Example 4, the screening of clones from the expression libraries was performed by measuring the conversion of α-alanine to β-alanine using liquid chromatography and mass spectrometry. Based upon the screening results, a set of the AAM polypeptides of the present disclosure are listed in Table 3 below along with their residue changes relative to the parental AAM polypeptide, i.e., the polypeptide of SEQ ID NO: 4, as well as their AAM activity (i.e., rate of production of β-alanine in μM/hour).

Enzymatic activities of exemplary engineered alanine 2,3-aminomutases are shown in Table 2, which shows the total μM of β-alanine produced after 17 hours and the rate of production of β-alanine in units of μM/hr.

TABLE 2

| SEQ ID NO. | uM β-alanine produced at t = 17 hrs | Rate of β-alanine μM produced/hr |
|---|---|---|
| 36 | 24.99 | 1.47 |
| 2218 | 25.35 | 1.49 |
| 794 | 24.1 | 1.42 |
| 804 | 42.11 | 2.48 |
| 910 | 106.28 | 6.25 |
| 2220 | 70.79 | 4.16 |
| 1282 | 88.52 | 5.21 |
| 2222 | 104 | 6.12 |
| 1696 | 107.12 | 6.3 |
| 1884 | 131.43 | 7.73 |
| 1886 | 119.0 | 7.00 |
| 2052 | 138 | 8.12 |
| 2162 | 157 | 9.23 |

Shown in Table 3 are exemplary AAMs with defined amino acid changes, which result in improved enzymatic activity. The set of changes in each enzyme, in addition to other such enzymes in the descriptions herein, provides the skilled artisan with guidance on the types and sets of amino acids that can be changed to obtain AAM polypeptides with improved enzymatic activity.

| SEQ ID NOS. | Residue Changes Relative to Parent SEQ ID NO: 4 | Rate of β-alanine produced: μM/hr |
|---|---|---|
| 36 | I339V | 1.47 |
| 794 | L26I; D33P; Q85K; Q95M; V192I; G300R; G331H; I339V; L399M | 1.42 |

| SEQ ID NOS. | Residue Changes Relative to Parent SEQ ID NO: 4 | Rate of β-alanine produced: µM/hr |
|---|---|---|
| 804 | L26I; K36E; Q85K; Q95M; F138Y; G331H; I339V; L399M | 2.48 |
| 910 | L261I; K36E Q95M; V292A G331H; I339V; V341L; T342A; N371D; I401L | 6.25 |
| 1282 | L261I; K36E Q85K; Q95M; V292A; G331H; I339V; T342A; N371D; K387R; I401L | 5.21 |
| 1696 | L261I; K36E; Q95M; V292A; G331H; N371D; I401L; S404P | 6.3 |
| 1884 | L261I; K36E Q85K; Q95M; A139T; K142R; V292A; G331H; I339V; T342A; N371D; E379V; K387R; I401L | 7.73 |
| 1886 | L261I; K36E Q85K; Q95M; A139T; V292A; G331H; I339V; T342A; N371D; K387R; I401L | 7.00 |
| 2052 | L261I; K36E; Q95M; D156E; T204A; M283I; V292A; G331H; I339V; N371D; G384D; I401L; S404P | 8.12 |
| 2162 | L261I; K36E; Q85K; Q95M; A139T; S202T; V292A; G331H; I339V; V341L; T342A; N371D; I401L | 9.23 |
| 2218 | L26I; K36E; Q95M; G300R; G331H | 1.49 |
| 2220 | L261I; K36E; Q95M; V292A; G331H; N371D; I401L | 4.16 |
| 2222 | L261I; K36E; Q95M; D156E; M283I; V292A; G331H; N371D; G384D; I401L; S404P | 6.12 |

As show in the exemplary engineered AAM above, the polypeptides, can have in some embodiments from 1 to 14 residue differences relative to SEQ ID NO: 4, and display significant AAM activity based on production of β-alanine in the assay of Example 4. As comparison, very little β-alanine productivity is detected for SEQ ID NO: 4 under the assay conditions used to test the AAM variants. Thus, in some embodiments, the engineered AAM polypeptide can have about 1-14 amino acid residue substitutions, 2-14 amino acid residue substitutions, 8-14 amino acid residue substitutions, or 12-14 amino acid residue substitutions.

In some embodiments, the amino acid substitutions of the above groupings are selected from the group of substitutions comprising Y8H, D20N, L26I, K36E, E51G, N74K, Q85R or K, Q86R, A91S, Q95M, L99V, T111P, C130S, R135S, A139T, Q141R, K142R, E149V, D156E, T163A, S202T, T204A, E244V, E247G, N251Y or S, R275G, M283I or V, V292A, L297M or F, I313T, N315S, G331H, I339V, V341L or I, T342A, H353R, V355I, V362A, I363T, N371D, A383V, G384D, K385E, K387R, A392T, G395E, I401L, S404P, K410E, K412R, or F413L or S.

In some embodiments, the polypeptide having improved alanine 2,3-aminomutase activity is selected from the amino acid sequences of SEQ ID NO: 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114 1116, 1118, 1170, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, 1288, 1290, 1292, 1294, 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614, 1616, 1670, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, 1820, 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 3132, 2134, 2136, 2138, 2140, 2142, 2144, 2146, 2148, 2150, 2152, 2154, 2156, 2158, 2160; 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, or 2222.

In some embodiments, the polypeptide with improved AAM enzyme activity is a polypeptide encoded by a polynucleotide sequence selected from, or which hybridizes under high stringency conditions, with the polynucleotide sequence or with a complement of SEQ ID NO: 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335; 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295, 1297, 1299, 1301, 1303, 1305, 1307, 1309, 1311, 1313, 1315, 1317, 1319, 1321, 1323, 1325, 1027, 1029, 1331, 1333, 1335, 1337, 1339, 1341, 1343, 1345, 1347, 1349, 1351, 1353, 1355, 1057, 1059, 1361, 1363, 1365, 1367, 1369, 1371, 1373, 1375, 1377, 1379, 1381, 1383, 1385, 1087, 1089, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1029, 1631, 1633, 1635, 1637, 1639, 1641, 1643, 1645, 1647, 1649, 1651, 1653, 1655, 1657, 1059, 1661, 1663, 1665, 1667, 1669, 1671, 1673, 1675, 1677, 1679, 1681, 1683, 1685, 1687, 1089, 1691, 1693, 1695, 1697, 1699, 1701, 1703, 1705, 1707, 1709, 1711, 1713, 1715, 1717, 1719, 1721, 1723, 1725, 1727, 1729, 1731, 1733, 1735, 1737, 1739, 1741, 1743, 1745, 1747, 1749, 1751, 1753, 1755, 1757, 1759, 1761, 1763, 1765, 1767, 1769, 1771, 1773, 1775, 1777, 1779, 1781, 1783, 1785, 1787, 1789, 1791, 1793, 1795, 1797, 1799, 1801, 1803, 1805, 1807, 1809, 1811, 1813, 1815, 1817, 1819, 1821, 1823, 1825, 1827, 1829, 1831, 1833, 1835, 1837, 1839, 1841, 1843, 1845, 1848, 1849, 1851, 1853, 1855, 1857, 1859, 1861, 1863, 1865, 1867, 1869, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, 2135, 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2183, 2185, 2187, 2189, 2191, 2193, 2195, 2197, 2199, 2201, 2203, 2205, 2207, 2209, 2211, 2213, 2215, 2217, 2219 or 2221, wherein the encoded polypeptide has greater alanine 2,3-aminomutase (AAM) activity than the polypeptide of SEQ ID NO: 4.

In some embodiments, the AAM polypeptide is selected from the amino acid sequences of SEQ ID NO: 36, 794, 804, 910, 1282, 1696, 1884, 1886, 2052, 2162, 2218, 2220, and 2222. In some embodiments, the AAM is selected from the amino acid sequences of SEQ ID NO: 910, 1262, 1696, 1884, 1886, 2052 and 2162. In some embodiments, the AMM has an amino acid sequence of SEQ ID NO: 2052 or 2162.

In some embodiments, the amino acid substitutions of the groupings are selected from one or more substitutions comprising: S4R; K7E; D15N; N19C; D2ON; L26I or T; D33P or G; T40A; L41P; E44G; E47G; K50Q;S51G; Y63H; Y64C; S66C; T68L or M; D69N; N74K or H; A81T; Q85R or K; A91S; Q95M or V; P98S; L99V; R113C; C130S; H132R; R135S; R137H; Q141R; I155V; T163A; S178G or C; Y184C; I185T; K187R or E; E190C; I197T or V; S202T; V206I or A; I212M; D218G; V226A; H230A; E244G or V; E247G; R248G, K, or M; M249I; A250T or V; A252T; D268G; H278Y; M283I or V; L297M or F; I299M; R303H; E311G; I313N, V, S, or T; S321L; Y323F; G336A; V341L, I, or A; V355I; V362A or I; I363T; T367A; E368G; Y372C; K385E; Q397R; Q398R; I400V; P4035, G, or T; and P413L, G, or S.

In some embodiments, the amino acid substitutions of the groupings are selected from one or more substitutions comprising SEQ ID NO:4 and which includes one or more substitutions selected from: A2S or T; S4C or N; Y8H; Y9F; F10W; E16K; Q17K; Y19H; H22R; I29V; K3OR; T31A or S; L32V; K36A; K37E; V49I; I68M; C75D; I77V; R78C; I82V; Q85K; Q86P; P106S; F120L; I122T or V, K142R, S145P, E149V, D156E, N160T, V164I, V177L, S178C, E180G, K187E, E191G, V192I, E196A or G, I197V, V198I, I200V, T204A, V206A, Q215H or R, V217A, K222R, Y223H, L228V, F232S, V238I, R248K or M, A250V, N251 S, I254V, T260S, I266V, R275K, L279K, K282N, 283I, I290M or V, G300R or S, F302L, I310T or V, I313V, N315S, F328Y, P333A, V341A, V347I, Y359F, V362I, E370D, E374G, D377G, E379V, C381S, R382H, A383V, G384D, H386Q, K387A or R, E388I, V390I, A392E or T, S394L, G395S, G396S, I401M, E402V, P403G, I, L, M, or T, S404P, D405N, L406S, A407E, K409E or M, K410D or E, K412R, P413G or S, D414G or V, K415E or R, and N416A.

In some embodiments, the polypeptide having improved AAM activity is selected from the amino acid sequences of SEQ ID NO: 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, 2502, 2504, 2506, 2508, 2510, 2512, 2514, 2516, 2518, 2520, 2522, 2524, 2526, 2528, 2530, 2532, 2534, 2536, 2538, 2540, 2542, 2544, 2546, 2548, 2550, 2552, 2554, 2556, 2558, 2560, 2562, 2564, 2566, 2568, 2570, 2572, 2574, 2576, 2578, 2580, 2582, 2584, 2586, 2588, 2590, 2592, 2594, 2596, 2598, 2600, 2602, 2604, 2606, 2608, 2610, 2612, 2614, 2616, 2618, 2620, 2622, 2624, 2626, 2628, 2630, 2632, 2634, 2636, 2638, 2640, 2642, 2644, 2646, 2648, 2650, 2652, 2654, 2656, 2658, 2660, 2662, 2664, 2666, 2668, 2670, 2672, 2674, 2676, 2678, 2680, 2682, 2684, 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764, 2766, 2768, 2770, 2772, 2774, 2776, 2778, 2780, 2782, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, 2836, 2838, 2840, 2842, 2844, 2846, 2848, 2850, 2852, 2854, 2856, 2858, 2860, 2862, 2864, 2866, 2868, 2870, 2872, 2874, 2876, 2878, 2880, 2882, 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, 3016, 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086, 3088, 3090, 3092, 3094, 3096, 3098, 3100, 3102, 3104, 3106, 3108, 3110, 3112, 3114, 3116, 3118, 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, 3180, 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372, 3374, 3376, 3378, 3380, 3382, 3384, 3386, 3388, 3390, 3392, 3394, 3396, 3398, 3400, 3402, 3404, 3406, 3408, 3410, 3412, 3414, 3416, 3418, 3420, 3422, 3424, 3426, 3428, 3430, 3432, 3434, 3436, 3438, 3440, 3442, 3444, 3446, 3448, 3450, 3452, 3454, 3456, 3458, 3460, 3462, 3464, 3466, 3468, 3470, 3472, 3474, 3476, 3478, 3480, 3482, 3484, 3486, 3488, 3490, 3492, 3494, 3496, 3498, 3500, 3502, 3504, 3506, 3508, 3510, 3512, 3514, 3516, 3518, 3520, 3522, 3524, 3526, 3528, 3530, 3532, 3534, 3536, 3538, 3540, 3542, 3544, 3546, 3548, 3550, 3552, 3554, 3556, 3558, 3560, 3562, 3564, 3566, 3568, 3570, 3572, 3574, 3576, 3578, 3580, 3582, 3584, 3586, 3588, 3590, 3592, 3594, 3596, 3598, 3600, 3602, 3604, 3606, 3608, 3610, 3612, 3614, 3616, 3618, 3620, 3622, 3624, 3626, 3628, 3630, 3632, 3634, 3636, 3638, 3640, 3642, 3644, 3646, 3648, 3650, 3652, 3654, 3656, 3658, 3660, 3662, 3664, 3666, 3668, 3670, 3672, 3674, 3676, 3678, 3680, 3682, 3684, 3686, 3688, 3690, 3692, 3694, 3696, 3698, 3700, 3702, 3704, 3706, 3708, 3710, 3712, 3714, 3716, 3718, 3720, 3722, 3724, 3726, 3728, 3730, 3732, 3734, 3736, 3738, 3740, 3742, 3744, 3746, 3748, 3750, 3752, 3754, 3756, 3758, 3760, 3762, 3764, 3766, 3768, 3770, 3772, 3774, 3776, 3778, 3780, 3782, 3784, 3786, 3788, 3790, 3792, 3794, 3796, 3798, 3800, 3802, 3804, 3806, 3808, 3810, 3812, 3814, 3816, 3818, 3820, 3822, 3824, 3826, 3828, 3830, 3832, 3834, 3836, 3838, 3840, 3842, 3844, 3846, 3848, 3850, 3852, 3854, 3856, 3858, 3860, 3862, 3864, 3866, 3868, 3870, 3872, 3874, 3876, 3878, 3880, 3882, 3884, 3886, 3888, 3890, 3892, 3894, 3896, 3898, 3900, 3902, 3904, 3906, 3908, 3910, 3912, 3914, 3916, 3918, 3920, 3922, 3924, 3926, 3928, 3930, 3932, 3934, 3936, 3938, 3940, 3942, 3944, 3946, 3948, 3950, 3952, 3954, 3956, 3958, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, 4022, 4024, 4026, 4028, 4030, 4032, 4034, 4036, 4038, 4040, 4042, 4044, 4046, 4048, 4050, 4052, 4054, 4056, 4058, 4060, 4062, 4064, 4066, 4068, 4070, 4072, 4074, 4076, 4078, 4080, 4082, 4084, 4086, 4088, 4090, 4092, 4094, 4096, 4098, 4100, 4102, 4104, 4106, 4108, 4110, 4112, 4114, 4116, 4118, 4120, 4122, 4124, 4126, 4128, 4130, 4132, 4134, 4136, 4138, 4140, 4142, 4144, 4146, 4148, 4150, 4152, 4154, 4156, 4158, 4160, 4162, 4164, 4166, 4168, 4170, 4172, 4174, 4176, 4178, 4180, 4182, 4184, 4186, 4188, 4190, 4192, 4194, 4196, 4198, 4200, 4202, 4204, 4206, 4208, 4210, 4212, 4214, 4216, 4218, 4220, 4222, 4224, 4226, 4228, 4230, 4232, 4234, 4236, 4238, 4240, 4242, 4244, 4246, 4248, 4250, 4252, 4254, 4256, 4258, 4260, 4262, 4264, 4266, 4268, 4270, 4272, 4274, 4276, 4278, 4280, 4282, 4284, 4286, 4288, 4290, 4292, 4294, 4296, 4298, 4300, 4302, 4304, 4306, 4308, 4310, 4312, 4314, 4316, 4318, 4320, 4322, 4324, 4326, 4328, 4330, 4332, 4334, 4336, 4338, 4340, 4342, 4344, 4346, 4348, 4350, 4352, 4354, 4356, 4358, 4360, 4362, 4364, 4366, 4368, 4370, 4372, 4374, 4376, 4378, 4380, 4382, 4384, 4386, 4388, 4390, 4392, 4394, 4396, 4398, 4400, 4402, 4404, 4406, 4408, 4410, 4412, 4414, 4416, 4418, 4420, 4422, 4424, 4426, 4428, 4430, 4432, 4434, 4436, 4438, 4440, 4442, 4444, 4446, 4448, 4450, 4452, 4454, 4456, 4458, 4460, 4462, 4464, 4466, 4468, 4470, 4472, 4474, 4476, 4478, 4480, 4482, 4484, 4486, 4488, 4490, 4492, 4494, 4496, 4498, 4500, 4502, 4504, 4506, 4508, 4510, 4512, 4514, 4516, 4518, 4520, 4522, 4524, 4526, 4528, 4530, 4532, 4534, 4536, 4538, 4540, 4542, 4544, 4546, 4548, 4550, 4552, 4554, 4556, 4558, 4560, 4562, 4564, 4566, 4568, 4570, 4572, 4574, 4576, 4578, 4580, 4582, 4584, 4586, 4588, 4590, 4592, 4594, 4596, 4598, 4600, 4602, 4604, 4606, 4608, 4610, 4612, 4614, 4616, 4618, 4620, 4622, 4624, 4626, 4628, 4630, 4632, 4634, 4636, 4638, 4640, 4642, 4644, 4646, 4648, 4650, 4652, 4654, 4656, 4658, 4660, 4662, 4664, 4666, 4668, 4670, 4672, 4674, 4676, 4678, 4680, 4682, 4684, 4686, 4688, 4690, 4692, 4694, 4696, 4698, 4700, 4702, 4704, 4706, 4708, 4710, 4712, 4714, 4716, 4718, 4720, 4722, 4724, 4726, 4728, 4730, 4732, 4734, 4736, 4738, 4740, 4742, 4744, 4746, 4748, 4750, 4752, 4754, 4756, 4758, 4760, 4762, 4764, 4766, 4768, 4770, 4772, 4774, 4776, 4778, 4780, 4782, 4784, 4786, 4788, 4790, 4792, 4794, 4796, 4798, 4800, 4802, 4804, 4806, 4808, 4810, 4812, 4814, 4816, 4818, 4820, 4822, 4824, 4826, 4828, 4830, 4832, 4834, 4836, 4838, 4840, 4842, 4844, 4846, 4848, 4850, 4852, 4854, 4856, 4858, 4860, 4862, 4864, 4866, 4868, 4870, 4872, 4874, 4876, 4878, 4880, 4882, 4884, 4886, 4888, 4890, 4892, 4894, 4896, 4898, 4900, 4902, 4904, 4906, 4908, 4910, 4912, 4914, 4916, 4918, 4920, 4922, 4924 4926, 4928, 4930, 4932, 4934, 4936, 4938, 4940, 4942, 4944, 4946, 4948, 4950, 4952, 4954, 4956, 4958, 4960, 4962, 4964, 4966, 4968, 4970, 4972, 4974, 4976, 4978, 4980, 4982, 4984, 4986, 4988, 4990, 4992, 4994, 4996, 4998, 5000, 5002, 5004, 5006, 5008, 5010, 5012, 5014, 5016, 5018, 5020, 5022, 5024, 5026, 5028, 5030, 5032, 5034, 5036, 5038, 5040, 5042, 5044, 5046, 5048, 5050, 5052, 5054, 5056, 5058, 5060, 5062, 5064, 5066, 5068, 5070, 5072, 5074, 5076, 5078, 5080, 5082, 5084, 5086, 5088, 5090, 5092, 5094, 5096, 5098, 5100, 5102, 5104, 5106, 5108, 5110, 5112, 5114, 5116, 5118, 5120, 5122, 5124, 5126, 5128, 5130, 5132, 5134, 5136, 5138, 5140, 5142, 5144, 5146, 5148, 5150, 5152, 5154, 5156, 5158, 5160, 5162, 5164, 5166, 5168, 5170, 5172, 5174, 5176, 5178, 5180, 5182, 5184, 5186, 5188, 5190, 5192, 5194, 5196, 5198, 5200, 5202, 5204, 5206, 5208, 5210, 5212, 5214, 5216, 5218, 5220, 5222, 5224, 5226, 5228, 5230, 5232, 5234, 5236, 5238, 5240, 5242, 5244, 5246, 5248, 5250, 5252, 5254, 5256, 5258, 5260, 5262, 5264, 5266, 5268, 5270, 5272, 5274, 5276, 5278, 5280, 5282, 5284, 5286, 5288, 5290, 5292, 5294, 5296, 5298, 5300, 5302, 5304, 5306, 5308, 5310, 5312, 5314, 5316, 5318, 5320, 5322, 5324, 5326, 5328, 5330, 5332, 5334, 5336, 5338, 5340, 5342, 5344, 5346, 5348, 5350, 5352, 5354, 5356, 5358, 5360, 5362, 5364, 5366, 5368, 5370, 5372, 5374, 5376, 5378, 5380, 5382, 5384, 5386, 5388, 5390, 5392, 5394, 5396, 5398, 5400, 5402, 5404, 5406, 5408, 5410, 5412, 5414, 5416, 5418, and 5420.

In some embodiments, the polypeptide with improved enzyme activity is a polypeptide encoded by a polynucleotide sequence selected from, or which hybridizes under high stringency conditions with the nucleotide sequence or a complement of SEQ ID NO: 2223, 2225, 2227, 2229, 2231, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, 2357, 2359, 2361, 2363, 2365, 2367, 2369, 2371, 2373, 2375, 2377, 2379, 2381, 2383, 2385, 2387, 2389, 2391, 2393, 2395, 2397, 2399, 2401, 2403, 2405, 2407, 2409, 2411, 2413, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2499, 2501, 2503, 2505, 2507, 2509, 2511, 2513, 2515, 2517, 2519, 2521, 2523, 2525, 2527, 2529, 2531, 2533, 2535, 2537, 2539, 2541, 2543, 2545, 2547, 2549, 2551, 2553, 2555, 2557, 2559, 2561, 2563, 2565, 2567, 2569, 2571, 2573, 2575, 2577, 2579, 2581, 2583, 2585, 2587, 2589, 2591, 2593, 2595, 2597, 2599, 2601, 2603, 2605, 2607, 2609, 2611, 2613, 2615, 2617, 2619, 2621, 2623, 2625, 2627, 2629, 2631, 2633, 2635, 2637, 2639, 2641, 2643, 2645, 2647, 2649, 2651, 2653, 2655, 2657, 2659, 2661, 2663, 2665, 2667, 2669, 2671, 2673, 2675, 2677, 2679, 2681, 2683, 2685, 2687, 2689, 2691, 2693, 2695, 2697, 2699, 2701, 2703, 2705, 2707, 2709, 2711, 2713, 2715, 2717, 2719, 2721, 2723, 2725, 2727, 2729, 2731, 2733, 2735, 2737, 2739, 2741, 2743, 2745, 2747, 2749, 2751, 2753, 2755, 2757, 2759, 2761, 2763, 2765, 2767, 2769, 2771, 2773, 2775, 2777, 2779, 2781, 2783, 2785, 2787, 2789, 2791, 2793, 2795, 2797, 2799, 2801, 2803, 2805, 2807, 2809, 2811, 2813, 2815, 2817, 2819, 2821, 2823, 2825, 2827, 2829, 2831, 2833, 2835, 2837, 2839, 2841, 2843, 2845, 2847, 2849, 2851, 2853, 2855, 2857, 2859, 2861, 2863, 2865, 2867, 2869, 2871, 2873, 2875, 2877, 2879, 2881, 2883, 2885, 2887, 2889, 2891, 2893, 2895, 2897, 2899, 2901, 2903, 2905, 2907, 2909, 2911, 2913, 2915, 2917, 2919, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, 2969, 2971, 2973, 2975, 2977, 2979, 2981, 2983, 2985, 2987, 2989, 2991, 2993, 2995, 2997, 2999, 3001, 3003, 3005, 3007, 3009, 3011, 3013, 3015, 3017, 3019, 3021, 3023, 3025, 3027, 3029, 3031, 3033, 3035, 3037, 3039, 3041, 3043, 3045, 3047, 3049, 3051, 3053, 3055, 3057, 3059, 3061, 3063, 3065, 3067, 3069, 3071, 3073, 3075, 3077, 3079, 3081, 3083, 3085, 3087, 3089, 3091, 3093, 3095, 3097, 3099, 3101, 3103, 3105, 3107, 3109, 3111, 3113, 3115, 3117, 3119, 3121, 3123, 3125, 3127, 3129, 3131, 3133, 3135, 3137, 3139, 3141, 3143, 3145, 3147, 3149, 3151, 3153, 3155, 3157, 3159, 3161, 3163, 3165, 3167, 3169, 3171, 3173, 3175, 3177, 3179, 3181, 3183, 3185, 3187, 3189, 3191, 3193, 3195, 3197, 3199, 3201, 3203, 3205, 3207, 3209, 3211, 3213, 3215, 3217, 3219, 3221, 3223, 3225, 3227, 3229, 3231, 3233, 3235, 3237, 3239, 3241, 3243, 3245, 3247, 3249, 3251, 3253, 3255, 3257, 3259, 3261, 3263, 3265, 3267, 3269, 3271, 3273, 3275, 3277, 3279, 3281, 3283, 3285, 3287, 3289, 3291, 3293, 3295, 3297, 3299, 3301, 3303, 3305, 3307, 3309, 3311, 3313, 3315, 3317, 3319, 3321, 3323, 3325, 3327, 3329, 3331, 3333, 3335, 3337, 3339, 3341, 3343, 3345, 3347, 3349, 3351, 3353, 3355, 3357, 3359, 3361, 3363, 3365, 3367, 3369, 3371, 3373, 3375, 3377, 3379, 3381, 3383, 3385, 3387, 3389, 3391, 3393, 3395, 3397, 3399, 3401, 3403, 3405, 3407, 3409, 3411, 3413, 3415, 3417, 3419, 3421, 3423, 3425, 3427, 3429, 3431, 3433, 3435, 3437, 3439, 3441, 3443, 3445, 3447, 3449, 3451, 3453, 3455, 3457, 3459, 3461, 3463, 3465, 3467, 3469, 3471, 3473, 3475, 3477, 3479, 3481, 3483, 3485, 3487, 3489, 3491, 3493, 3495, 3497, 3499, 3501, 3503, 3505, 3507, 3509, 3511, 3513, 3515, 3517, 3519, 3521, 3523, 3525, 3527, 3529, 3531, 3533, 3535, 3537, 3539, 3541, 3543, 3545, 3547, 3549, 3551, 3553, 3555, 3557, 3559, 3561, 3563, 3565, 3567, 3569, 3571, 3573, 3575, 3577, 3579, 3581, 3583, 3585, 3587, 3589, 3591, 3593, 3595, 3597, 3599, 3601, 3603, 3605, 3607, 3609, 3611, 3613, 3615, 3617, 3619, 3621, 3623, 3625, 3627, 3629, 3631, 3633, 3635, 3637, 3639, 3641, 3643, 3645, 3647, 3649, 3651, 3653, 3655, 3657, 3659, 3661, 3663, 3665, 3667, 3669, 3671, 3673, 3675, 3677, 3679, 3681, 3683, 3685, 3687, 3689, 3691, 3693, 3695, 3697, 3699, 3701, 3703, 3705, 3707, 3709, 3711, 3713, 3715, 3717, 3719, 3721, 3723, 3725, 3727, 3729, 3731, 3733, 3735, 3737, 3739, 3741, 3743, 3745, 3747, 3749, 3751, 3753, 3755, 3757, 3759, 3761, 3763, 3765, 3767, 3769, 3771, 3773, 3775, 3777, 3779, 3781, 3783, 3785, 3787, 3789, 3791, 3793, 3795, 3797, 3799, 3801, 3803, 3805, 3807, 3809, 3811, 3813, 3815, 3817, 3819, 3821, 3823, 3825, 3827, 3829, 3831, 3833, 3835, 3837, 3839, 3841, 3843, 3845, 3847, 3849, 3851, 3853, 3855, 3857, 3859, 3861, 3863, 3865, 3867, 3869, 3871, 3873, 3875, 3877, 3879, 3881, 3883, 3885, 3887, 3889, 3891, 3893, 3895, 3897, 3899, 3901, 3903, 3905, 3907, 3909, 3911, 3913, 3915, 3917, 3919, 3921, 3923, 3925, 3927, 3929, 3931, 3933, 3935, 3937, 3939, 3941, 3943, 3945, 3947, 3949, 3951, 3953, 3955, 3957, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, 4019, 4021, 4023, 4025, 4027, 4029, 4031, 4033, 4035, 4037, 4039, 4041, 4043, 4045, 4047, 4049, 4051, 4053, 4055, 4057, 4059, 4061, 4063, 4065, 4067, 4069, 4071, 4073, 4075, 4077, 4079, 4081, 4083, 4085, 4087, 4089, 4091, 4093, 4095, 4097, 4099, 4101, 4103, 4105, 4107, 4109, 4111, 4113, 4115, 4117, 4119, 4121, 4123, 4125, 4127, 4129, 4131, 4133, 4135, 4137, 4139, 4141, 4143, 4145, 4147, 4149, 4151, 4153, 4155, 4157, 4159, 4161, 4163, 4165, 4167, 4169, 4171, 4173, 4175, 4177, 4179, 4181, 4183, 4185, 4187, 4189, 4191, 4193, 4195, 4197, 4199, 4201, 4203, 4205, 4207, 4209, 4211, 4213, 4215, 4217, 4219, 4221, 4223, 4225, 4227, 4229, 4231, 4233, 4235, 4237, 4239, 4241, 4243, 4245, 4247, 4249, 4251, 4253, 4255, 4257, 4259, 4261, 4263, 4265, 4267, 4269, 4271, 4273, 4275, 4277, 4279, 4281, 4283, 4285, 4287, 4289, 4291, 4293, 4295, 4297, 4299, 4301, 4303, 4305, 4307, 4309, 4311, 4313, 4315, 4317, 4319, 4321, 4323, 4325, 4327, 4329, 4331, 4333, 4335, 4337, 4339, 4341, 4343, 4345, 4347, 4349, 4351, 4353, 4355, 4357, 4359, 4361, 4363, 4365, 4367, 4369, 4371, 4373, 4375, 4377, 4379, 4381, 4383, 4385, 4387, 4389, 4391, 4393, 4395, 4397, 4399, 4401, 4403, 4405, 4407, 4409, 4411, 4413, 4415, 4417, 4419, 4421, 4423, 4425, 4427, 4429, 4431, 4433, 4435, 4437, 4439, 4441, 4443, 4445, 4447, 4449, 4451, 4453, 4455, 4457, 4459, 4461, 4463, 4465, 4467, 4469, 4471, 4473, 4475, 4477, 4479, 4481, 4483, 4485, 4487, 4489, 4491, 4493, 4495, 4497, 4499, 4501, 4503, 4505, 4507, 4509, 4511, 4513, 4515, 4517, 4519, 4521, 4523, 4525, 4527, 4529, 4531, 4533, 4535, 4537, 4539, 4541, 4543, 4545, 4547, 4549, 4551, 4553, 4555, 4557, 4559, 4561, 4563, 4565, 4567, 4569, 4571, 4573, 4575, 4577, 4579, 4581, 4583, 4585, 4587, 4589, 4591, 4593, 4595, 4597, 4599, 4601, 4603, 4605, 4607, 4609, 4611, 4613, 4615, 4617, 4619, 4621, 4623, 4625, 4627, 4629, 4631, 4633, 4635, 4637, 4639, 4641, 4643, 4645, 4647, 4649, 4651, 4653, 4655, 4657, 4659, 4661, 4663, 4665, 4667, 4669, 4671, 4673, 4675, 4677, 4679, 4681, 4683, 4685, 4687, 4689, 4691, 4693, 4695, 4697, 4699, 4701, 4703, 4705, 4707, 4709, 4711, 4713, 4715, 4717, 4719, 4721, 4723, 4725, 4727, 4729, 4731, 4733, 4735, 4737, 4739, 4741, 4743, 4745, 4747, 4749, 4751, 4753, 4755, 4757, 4759, 4761, 4763, 4765, 4767, 4769, 4771, 4773, 4775, 4777, 4779, 4781, 4783, 4785, 4787, 4789, 4791, 4793, 4795, 4797, 4799, 4801, 4803, 4805, 4807, 4809, 4811, 4813, 4815, 4817, 4819, 4821, 4823, 4825, 4827, 4829, 4831, 4833, 4835, 4837, 4839, 4841, 4843, 4845, 4847, 4849, 4851, 4853, 4855, 4857, 4859, 4861, 4863, 4865, 4867, 4869, 4871, 4873, 4875, 4877, 4879, 4881, 4883, 4885, 4887, 4889, 4891, 4893, 4895, 4897, 4899, 4901, 4903, 4905, 4907, 4909, 4911, 4913, 4915, 4917, 4919, 4921, 4923, 4925, 4927, 4929, 4931, 4933, 4935, 4937, 4939, 4941, 4943, 4945, 4947, 4949, 4951, 4953, 4955, 4957, 4959, 4961, 4963, 4965, 4967, 4969, 4971, 4973, 4975, 4977, 4979, 4981, 4983, 4985, 4987, 4989, 4991, 4993, 4995, 4997, 4999, 5001, 5003, 5005, 5007, 5009, 5011, 5013, 5015, 5017, 5019, 5021, 5023, 5025, 5027, 5029, 5031, 5033, 5035, 5037, 5039, 5041, 5043, 5045, 5047, 5049, 5051, 5053, 5055, 5057, 5059, 5061, 5063, 5065, 5067, 5069, 5071, 5073, 5075, 5077, 5079, 5081, 5083, 5085, 5087, 5089, 5091, 5093, 5095, 5097, 5099, 5101, 5103, 5105, 5107, 5109, 5111, 5113, 5115, 5117, 5119, 5121, 5123, 5125, 5127, 5129, 5131, 5133, 5135, 5137, 5139, 5141, 5143, 5145, 5147, 5149, 5151, 5153, 5155, 5157, 5159, 5161, 5163, 5165, 5167, 5169, 5171, 5173, 5175, 5177, 5179, 5181, 5183, 5185, 5187, 5189, 5191, 5193, 5195, 5197, 5199, 5201, 5203, 5205, 5207, 5209, 5211, 5213, 5215, 5217, 5219, 5221, 5223, 5225, 5227, 5229, 5231, 5233, 5235, 5237, 5239, 5241, 5243, 5245, 5247, 5249, 5251, 5253, 5255, 5257, 5259, 5261, 5263, 5265, 5267, 5269, 5271, 5273, 5275, 5277, 5279, 5281, 5283, 5285, 5287, 5289, 5291, 5293, 5295, 5297, 5299, 5301, 5303, 5305, 5307, 5309, 5311, 5313, 5315, 5317, 5319, 5321, 5323, 5325, 5327, 5329, 5331, 5333, 5335, 5337, 5339, 5341, 5343, 5345, 5347, 5349, 5351, 5353, 5355, 5357, 5359, 5361, 5363, 5365, 5367, 5369, 5371, 5373, 5375, 5377, 5379, 5381, 5383, 5385, 5387, 5389, 5391, 5393, 5395, 5397, 5399, 5401, 5403, 5405, 5407, 5409, 5411, 5413, 5415, 5417, and 5419.

In some embodiments, the engineered AAM polypeptide is selected from the polypeptide sequences of SEQ ID NO: 2348, 2286, 2230, 2312, 2282, 2346, 2338, 2226, 2268, 2324, and 2240.

In some embodiments, the engineered alanine-2,3-aminomutase polypeptide is selected from the polypeptide sequences of SEQ ID NO: 2306, 2294, 2250, 2300, 2256, 2244, 2242, 2232, 2358, and 2238.

It is to be understood that the engineered AAMs are not limited to those identified directly by mutagenesis or other gene evolution techniques, but can also include variants or analogs of the improved engineered AAM polypeptides. The term "variant" and "analog" are used interchangeably herein to refer to polypeptides which are comprised of a segment having AAM activity, with or without retention of the improved property, and has substantial identity to a portion or the whole of the engineered AAM enzyme. In some embodiments, variant AAM polypeptides can comprise a conservative amino acid substitution, or addition or deletion of one or more amino acid residues with respect to the engineered sequence. Variants typically are at least an enzymatically active fragment and typically as long as the full-length naturally-occurring reference polypeptide. Thus, in some embodiments, the variants herein include AAM polypeptides with conservative substitutions in each of the AAM polypeptides in the Sequence Listing, where the substitutions are in addition to the substitutions present in the specific AAM polypeptide.

In some embodiments, the variant or analog of the engineered AAM can comprise an enzymatically active AAM polypeptide that has at least about 70% or more amino acid identity, at least about 80% or more amino acid identity, at least about 90% or more amino acid identity, at least about 95% or more amino acid identity, at least about 97% or more amino acid identity, at least about 98% or more amino acid identity, or at least about 99% or more amino acid identity to the wild type *Porphyromonas gingivalis* enzyme (i.e., SEQ ID NO:2) or to a reference engineered AAM or an enzymatically active fragment of an AAM disclosed herein, such as, for example, SEQ ID NO:4, SEQ ID NO:36, and SEQ ID NO:909, and each of the amino acid sequences of the engineered AAMs listed in the Sequence Listing of this disclosure, beginning form SEQ ID NO:6.

In such embodiments, as noted above, the level of improvements in enzyme activity can be from 1.5 times the enzymatic activity of the corresponding reference AAM enzyme, to as much as 2 times, 5 times, 10 times, 20 times, 25 times, 30 times, up to 50 times or more times enzymatic activity than the reference enzyme. In some embodiments, the engineered AAM can have improved enzymatic activity in the range of 1.5 to 5 times; 1.5 to 10 times; 1.5 to 20 times; 1.5 to 30 times; 1.5 to 40 times, or 1.5 to 50 or more times greater than that of the AAM enzyme from which it was derived. Thus, in some embodiments, the variants of the engineered AAM enzymes can have from about 1.5 to 30 times greater, from 2 to about 30 time greater, or 5 to about 30 times greater AAM activity as compared to the AAM polypeptide of SEQ ID NO:4. In some embodiments, variants may have from about 1.5 to about 10 or more times greater AAM activity compared to the AAM polypeptide of SEQ ID NO:36.

In some embodiments, the engineered polypeptide having improved AAM activity is a polypeptide having at least 97% identity to a polypeptide selected from SEQ ID NO: 295, 2068 or 2150.

In some embodiments, the engineered polypeptide having improved AAM activity is a polypeptide having at least 98% identity to a polypeptide selected from SEQ ID NO: 258, 316, 350, 356, 790, 1006, and 1250

In some embodiments, the engineered polypeptide having improved enzymatic activity is a polypeptide having at least 99% identity to a polypeptide selected from SEQ ID NO: 14, 24, 58, 86, 100, 312, 336, 380, 318, 404, 444, 490, 550 and 774.

In some embodiments, the engineered AAM polypeptide having improved enzymatic activity is a polypeptide having at least 93% identity to the polypeptide of SEQ ID NO:4288.

In some embodiments, the engineered alanine-2,3-aminomutase polypeptide having improved enzymatic activity is polypeptide having at least about 95% sequence identity to a polypeptide selected from SEQ ID NO: 2670, 2666, 4288, and 4586.

In some embodiments, the engineered AAM polypeptide having improved AAM activity is a polypeptide having at least 96% identity to a polypeptide selected from SEQ ID NO: 2378 and 2380.

In some embodiments, the engineered AAM polypeptide having improved enzymatic activity is a polypeptide having at least 99% identity to a polypeptide selected from SEQ ID NO: 2226, 2240, 2268, 2286, 2282, 2312, 2316, 2324, 2338, 2346, and 2348.

As noted above, these variant polypeptides have greater AAM activity than the polypeptide of SEQ ID NO:4, as measured in the assays in the Examples (e.g., Example 4). Some have greater AAM activity than the polypeptide of SEQ ID NO:36 while others may have greater AAM activity than the polypeptide of SEQ ID NO:909.

It is also within the scope of the present disclosure that the polypeptides described herein, include fragments thereof which have detectable AAM activity and that are deleted of portions of the polypeptide as compared to the wild-type or engineered reference polypeptide, as discussed above. The term "fragment" as used herein refers to a polypeptide that has an amino-terminal, carboxy-terminal, or internal deletion, but where the remaining amino acid sequence is identical to the corresponding positions in the sequence. Fragments can be at least 14 amino acids long, at least 20 amino acids long, at least 50 amino acids long or longer, and up to 70%, 80%, 90%, 95%, 98%, and 99% of the full-length, naturally-occurring or other reference AAM polypeptide. In some embodiments, the deletions may be from 1 to 8 residues from their N-terminus relative to the parental sequence of SEQ ID NO:4, typically from 1 to 7 residues, more typically from 1-6 residues, most typically from 1 to 5 residues. In some embodiments, the above-described N-terminal truncation can be utilized in combination with a C-terminal truncation. In some embodiments, AAM fragments may have deleted from 1 to 45 amino acid residues from their C-terminus relative to SEQ ID NO:4, typically from 1 to 40 residues, sometimes from 1-35 residues, in some embodiments from 1 to 30 residues, 1 to 25 residues, 1 to 20 residues, 1 to 15 residues 1 to 10 residues, and 1 to 5 residues.

In some embodiments, segments of the engineered improved AAM polypeptides can be deleted to generate polypeptide fragments. Thus in some embodiments, the present disclosure is directed to a fragment of a polypeptide listed in the Sequence Listing herein, that has improved enzymatic activity as compared to the AAM polypeptide of SEQ ID NO: 4. In such embodiments, the fragments of the engineered AAM enzymes can have from about 1.5 to 30 times greater, from 2 to about 30 time greater, or 5 to about 30 times greater AAM activity as compared to the AAM polypeptide of SEQ ID NO: 4. Some fragments may have from about 1.5 to about 10 or more times greater AAM activity compared to the AAM polypeptide of SEQ ID NO: 36.

The improved AAM enzymes may be present within a cell, present in the cellular medium, or prepared in various forms, such as lysates, lyophilizates, or isolated preparations. In some embodiments, the AAM polypeptides are sensitive to oxygen and therefore can be maintained and used in an oxygen deficient environment. If the AAM polypeptide becomes inactivated due to exposure to oxygen, it can be activated by anaerobic incubation with a sulfhydryl compound for one hour at 37° C. in accordance with the method described in Chirpich, et al., 1970, *J Biol. Chem.* 245(7):1778-1789, which is incorporated herein by reference in its entirety. Thus, in some embodiments, the AAM polypeptides can be used in whole cell form (i.e., as a whole cell transformed with an AAM polynucleotide that is used under conditions such that the encoded AAM polypeptide is expressed in the cell) or alternatively, both isolated and utilized under anoxic conditions. AAM polypeptides of the present disclosure may be isolated, and optionally purified, under anaerobic conditions (e.g., under a nitrogen atmosphere) in accordance with the method described in Petrovich, et al., 1991, *J Biol Chem.* 266(12):7656-7660, which describes the isolation and purification of lysine-2,3-aminomutase and which is incorporated herein by reference in its entirety. As used herein, the term "anoxic" refers to oxygen deficient. In some embodiments, the AAM polypeptides may be prepared in the oxidized from, and then activated as discussed above.

The term "isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis).

In some embodiments, the isolated improved AAM polypeptide is a substantially pure polypeptide composition. The term "substantially pure polypeptide" refers to a composition in which the polypeptide species is the predominant species present (i.e., on a molar or weight basis, it is more abundant than any other individual macromolecular species in the composition), and is generally a substantially purified composition when the object species comprises at least about 50 percent of the macromolecular species present by mole or % weight. Generally, a substantially pure AAM composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species.

In other embodiments, the engineered AAM can be provided as a composition comprising an AAM polypeptide as described herein (e.g., in whole cell form or as an isolated polypeptide) and a suitable carrier, typically a buffer, more typically an aqueous buffer solution having a pH from about 6.0 to about 8.0. In some embodiments, the aqueous buffered composition can be lyophilized to provide a composition in a lyophilized form, wherein the composition is reconstituted by the addition of an aqueous based composition. In other embodiments, the composition comprises an engineered AAM polypeptide in a glycerol solution. In this latter embodiment, the composition is capable of being stored at −20° C. to −40° C. without freezing.

7.3 Polynucleotides Encoding AAM

The present disclosure further provides polynucleotide sequences that encode AAM polypeptides with improved enzymatic activity. The polynucleotides may be operatively linked to one or more heterologous regulatory sequences that control gene expression to create a recombinant polynucleotide capable of expressing the polypeptide. Expression constructs containing a heterologous polynucleotide encoding the engineered AAM can be introduced into appropriate host cells to express the corresponding AAM polypeptide. The term "heterologous" polynucleotide refers to any polynucleotide that is introduced into a host cell by laboratory techniques, and includes polynucleotides that are removed from a host cell, subjected to laboratory manipulation, and then reintroduced into a host cell.

Because of the knowledge of the codons corresponding to the various amino acids, availability of a protein sequence provides a description of all the polynucleotides capable of encoding the subject polypeptide. The degeneracy of the genetic code, where the same amino acids are encoded by alternative or synonymous codons allows an extremely large number of nucleic acids to be made, all of which encode the improved AAM enzymes disclosed herein. Thus, having identified a particular amino acid sequence, those skilled in the art could make any number of different nucleic acids by simply modifying the sequence of one or more codons in a way which does not change the amino acid sequence of the protein. In this regard, the present disclosure specifically contemplates each and every possible variation of polynucleotides that could be made by selecting combinations based on the possible codon choices, and all such variations are to be considered specifically disclosed for any polypeptide disclosed herein.

In some embodiments, the polynucleotides encoding the AAM enzymes may be codon optimized for optimal production in the host organism selected for expression. The term "codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. The terms "preferred," "optimal," or "high codon usage bias" codons refer interchangeably to codons that are used at higher frequency in the protein coding regions than other codons that code for the same amino acid.

Codon usage tables are available for a growing list of organisms (see for example, Wada et al., 1992, *Nucleic Acids Res.* 20:2111-2118; Nakamura et al., 2000, *Nucl. Acids Res.* 28:292; Duret, et al., supra; Henaut and Danchin, "*Escherichia coli* and *Salmonella*," 1996, Neidhardt, et al. Eds., ASM Press, Washington D.C., p. 2047-2066. The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (see for example, Mount, D., *Bioinformatics: Sequence and Genome Analysis*, Chapter 8, Cold Spring Harbor Laboratory Press, Cold Spring Harbor, N.Y., 2001; Uberbacher, E. C., 1996, *Methods Enzymol.* 266: 259-281; and Tiwari et al., 1997, *Comput. Appl. Biosci.* 13:263-270).

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. By way of example, the polynucleotide of SEQ ID NO: 5 has been codon optimized for expression in *E. coli*.

In a some embodiments, the polynucleotide encoding the engineered AAM polypeptide with improved enzyme activity is selected from SEQ ID NOS: 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295, 1297, 1299, 1301, 1303, 1305, 1307, 1309, 1311, 1313, 1315, 1317, 1319, 1321, 1323, 1325, 1027, 1029, 1331, 1333, 1335, 1337, 1339, 1341, 1343, 1345, 1347, 1349, 1351, 1353, 1355, 1057, 1059, 1361, 1363, 1365, 1367, 1369, 1371, 1373, 1375, 1377, 1379, 1381, 1383, 1385, 1087, 1089, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1029, 1631, 1633, 1635, 1637, 1639, 1641, 1643, 1645, 1647, 1649, 1651, 1653, 1655, 1657, 1059, 1661, 1663, 1665, 1667, 1669, 1671, 1673, 1675, 1677, 1679, 1681, 1683, 1685, 1687, 1089, 1691, 1693, 1695, 1697, 1699, 1701, 1703, 1705, 1707, 1709, 1711, 1713, 1715, 1717, 1719, 1721, 1723, 1725, 1727, 1729, 1731, 1733, 1735, 1737, 1739, 1741, 1743, 1745, 1747, 1749, 1751, 1753, 1755, 1757, 1759, 1761, 1763, 1765, 1767, 1769, 1771, 1773, 1775, 1777, 1779, 1781, 1783, 1785, 1787, 1789, 1791, 1793, 1795, 1797, 1799, 1801, 1803, 1805, 1807, 1809, 1811, 1813, 1815, 1817, 1819, 1821, 1823, 1825, 1827, 1829, 1831, 1833, 1835, 1837, 1839, 1841, 1843, 1845, 1848, 1849, 1851, 1853, 1855, 1857, 1859, 1861, 1863, 1865, 1867, 1869, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, 2135, 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2183, 2185, 2187, 2189, 2191, 2193, 2195, 2197, 2199, 2201, 2203, 2205, 2207, 2209, 2211, 2213, 2215, 2217, 2219 or 2221.

In some embodiments, the AAM encoding polynucleotides have the sequence selected from SEQ ID NO: 35, 793, 803, 909, 1281, 1695, 1883, 1885, 2051 and 2161 or have the sequence selected from SEQ ID NO: 909, 1261, 1695; 1883, 1885, 2051 and 2161. In some embodiments, the polynucleotide is SEQ ID NO: 2051 or SEQ ID NO:2161.

In some embodiments, the polynucleotide encoding the engineered AAM polypeptide is selected from SEQ ID NO: 2223, 2225, 2227, 2229, 2231, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, 2357, 2359, 2361, 2363, 2365, 2367, 2369, 2371, 2373, 2375, 2377, 2379, 2381, 2383, 2385, 2387, 2389, 2391, 2393, 2395, 2397, 2399, 2401, 2403, 2405, 2407, 2409, 2411, 2413, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2499, 2501, 2503, 2505, 2507, 2509, 2511, 2513, 2515, 2517, 2519, 2521, 2523, 2525, 2527, 2529, 2531, 2533, 2535, 2537, 2539, 2541, 2543, 2545, 2547, 2549, 2551, 2553, 2555, 2557, 2559, 2561, 2563, 2565, 2567, 2569, 2571, 2573, 2575, 2577, 2579, 2581, 2583, 2585, 2587, 2589, 2591, 2593, 2595, 2597, 2599, 2601, 2603, 2605, 2607, 2609, 2611, 2613, 2615, 2617, 2619, 2621, 2623, 2625, 2627, 2629, 2631, 2633, 2635, 2637, 2639, 2641, 2643, 2645, 2647, 2649, 2651, 2653, 2655, 2657, 2659, 2661, 2663, 2665, 2667, 2669, 2671, 2673, 2675, 2677, 2679, 2681, 2683, 2685, 2687, 2689, 2691, 2693, 2695, 2697, 2699, 2701, 2703, 2705, 2707, 2709, 2711, 2713, 2715, 2717, 2719, 2721, 2723, 2725, 2727, 2729, 2731, 2733, 2735, 2737, 2739, 2741, 2743, 2745, 2747, 2749, 2751, 2753, 2755, 2757, 2759, 2761, 2763, 2765, 2767, 2769, 2771, 2773, 2775, 2777, 2779, 2781, 2783, 2785, 2787, 2789, 2791, 2793, 2795, 2797, 2799, 2801, 2803, 2805, 2807, 2809, 2811, 2813, 2815, 2817, 2819, 2821, 2823, 2825, 2827, 2829, 2831, 2833, 2835, 2837, 2839, 2841, 2843, 2845, 2847, 2849, 2851, 2853, 2855, 2857, 2859, 2861, 2863, 2865, 2867, 2869, 2871, 2873, 2875, 2877, 2879, 2881, 2883, 2885, 2887, 2889, 2891, 2893, 2895, 2897, 2899, 2901, 2903, 2905, 2907, 2909, 2911, 2913, 2915, 2917, 2919, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, 2969, 2971, 2973, 2975, 2977, 2979, 2981, 2983, 2985, 2987, 2989, 2991, 2993, 2995, 2997, 2999, 3001, 3003, 3005, 3007, 3009, 3011, 3013, 3015, 3017, 3019, 3021, 3023, 3025, 3027, 3029, 3031, 3033, 3035, 3037, 3039, 3041, 3043, 3045, 3047, 3049, 3051, 3053, 3055, 3057, 3059, 3061, 3063, 3065, 3067, 3069, 3071, 3073, 3075, 3077, 3079, 3081, 3083, 3085, 3087, 3089, 3091, 3093, 3095, 3097, 3099, 3101, 3103, 3105, 3107, 3109, 3111, 3113, 3115, 3117, 3119, 3121, 3123, 3125, 3127, 3129, 3131, 3133, 3135, 3137, 3139, 3141, 3143, 3145, 3147, 3149, 3151, 3153, 3155, 3157, 3159, 3161, 3163, 3165, 3167, 3169, 3171, 3173, 3175, 3177, 3179, 3181, 3183, 3185, 3187, 3189, 3191, 3193, 3195, 3197, 3199, 3201, 3203, 3205, 3207, 3209, 3211, 3213, 3215, 3217, 3219, 3221, 3223, 3225, 3227, 3229, 3231, 3233, 3235, 3237, 3239, 3241, 3243, 3245, 3247, 3249, 3251, 3253, 3255, 3257, 3259, 3261, 3263, 3265, 3267, 3269, 3271, 3273, 3275, 3277, 3279, 3281, 3283, 3285, 3287, 3289, 3291, 3293, 3295, 3297, 3299, 3301, 3303, 3305, 3307, 3309, 3311, 3313, 3315, 3317, 3319, 3321, 3323, 3325, 3327, 3329, 3331, 3333, 3335, 3337, 3339, 3341, 3343, 3345, 3347, 3349, 3351, 3353, 3355, 3357, 3359, 3361, 3363, 3365, 3367, 3369, 3371, 3373, 3375, 3377, 3379, 3381, 3383, 3385, 3387, 3389, 3391, 3393, 3395, 3397, 3399, 3401, 3403, 3405, 3407, 3409, 3411, 3413, 3415, 3417, 3419, 3421, 3423, 3425, 3427, 3429, 3431, 3433, 3435, 3437, 3439, 3441, 3443, 3445, 3447, 3449, 3451, 3453, 3455, 3457, 3459, 3461, 3463, 3465, 3467, 3469, 3471, 3473, 3475, 3477, 3479, 3481, 3483, 3485, 3487, 3489, 3491, 3493, 3495, 3497, 3499, 3501, 3503, 3505, 3507, 3509, 3511, 3513, 3515, 3517, 3519, 3521, 3523, 3525, 3527, 3529, 3531, 3533, 3535, 3537, 3539, 3541, 3543, 3545, 3547, 3549, 3551, 3553, 3555, 3557, 3559, 3561, 3563, 3565, 3567, 3569, 3571, 3573, 3575, 3577, 3579, 3581, 3583, 3585, 3587, 3589, 3591, 3593, 3595, 3597, 3599, 3601, 3603, 3605, 3607, 3609, 3611, 3613, 3615, 3617, 3619, 3621, 3623, 3625, 3627, 3629, 3631, 3633, 3635, 3637, 3639, 3641, 3643, 3645, 3647, 3649, 3651, 3653, 3655, 3657, 3659, 3661, 3663, 3665, 3667, 3669, 3671, 3673, 3675, 3677, 3679, 3681, 3683, 3685, 3687, 3689, 3691, 3693, 3695, 3697, 3699, 3701, 3703, 3705, 3707, 3709, 3711, 3713, 3715, 3717, 3719, 3721, 3723, 3725, 3727, 3729, 3731, 3733, 3735, 3737, 3739, 3741, 3743, 3745, 3747, 3749, 3751, 3753, 3755, 3757, 3759, 3761, 3763, 3765, 3767, 3769, 3771, 3773, 3775, 3777, 3779, 3781, 3783, 3785, 3787, 3789, 3791, 3793, 3795, 3797, 3799, 3801, 3803, 3805, 3807, 3809, 3811, 3813, 3815, 3817, 3819, 3821, 3823, 3825, 3827, 3829, 3831, 3833, 3835, 3837, 3839, 3841, 3843, 3845, 3847, 3849, 3851, 3853, 3855, 3857, 3859, 3861, 3863, 3865, 3867, 3869, 3871, 3873, 3875, 3877, 3879, 3881, 3883, 3885, 3887, 3889, 3891, 3893, 3895, 3897, 3899, 3901, 3903, 3905, 3907, 3909, 3911, 3913, 3915, 3917, 3919, 3921, 3923, 3925, 3927, 3929, 3931, 3933, 3935, 3937, 3939, 3941, 3943, 3945, 3947, 3949, 3951, 3953, 3955, 3957, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, 4019, 4021, 4023, 4025, 4027, 4029, 4031, 4033, 4035, 4037, 4039, 4041, 4043, 4045, 4047, 4049, 4051, 4053, 4055, 4057, 4059, 4061, 4063, 4065, 4067, 4069, 4071, 4073, 4075, 4077, 4079, 4081, 4083, 4085, 4087, 4089, 4091, 4093, 4095, 4097, 4099, 4101, 4103, 4105, 4107, 4109, 4111, 4113, 4115, 4117, 4119, 4121, 4123, 4125, 4127, 4129, 4131, 4133, 4135, 4137, 4139, 4141, 4143, 4145, 4147, 4149, 4151, 4153, 4155, 4157, 4159, 4161, 4163, 4165, 4167, 4169, 4171, 4173, 4175, 4177, 4179, 4181, 4183, 4185, 4187, 4189, 4191, 4193, 4195, 4197, 4199, 4201, 4203, 4205, 4207, 4209, 4211, 4213, 4215, 4217, 4219, 4221, 4223, 4225, 4227, 4229, 4231, 4233, 4235, 4237, 4239, 4241, 4243, 4245, 4247, 4249, 4251, 4253, 4255, 4257, 4259, 4261, 4263, 4265, 4267, 4269, 4271, 4273, 4275, 4277, 4279, 4281, 4283, 4285, 4287, 4289, 4291, 4293, 4295, 4297, 4299, 4301, 4303, 4305, 4307, 4309, 4311, 4313, 4315, 4317, 4319, 4321, 4323, 4325, 4327, 4329, 4331, 4333, 4335, 4337, 4339, 4341, 4343, 4345, 4347, 4349, 4351, 4353, 4355, 4357, 4359, 4361, 4363, 4365, 4367, 4369, 4371, 4373, 4375, 4377, 4379, 4381, 4383, 4385, 4387, 4389, 4391, 4393, 4395, 4397, 4399, 4401, 4403, 4405, 4407, 4409, 4411, 4413, 4415, 4417, 4419, 4421, 4423, 4425, 4427, 4429, 4431, 4433, 4435, 4437, 4439, 4441, 4443, 4445, 4447, 4449, 4451, 4453, 4455, 4457, 4459, 4461, 4463, 4465, 4467, 4469, 4471, 4473, 4475, 4477, 4479, 4481, 4483, 4485, 4487, 4489, 4491, 4493, 4495, 4497, 4499, 4501, 4503, 4505, 4507, 4509, 4511, 4513, 4515, 4517, 4519, 4521, 4523, 4525, 4527, 4529, 4531, 4533, 4535, 4537, 4539, 4541, 4543, 4545, 4547, 4549, 4551, 4553, 4555, 4557, 4559, 4561, 4563, 4565, 4567, 4569, 4571, 4573, 4575, 4577, 4579, 4581, 4583, 4585, 4587, 4589, 4591, 4593, 4595, 4597, 4599, 4601, 4603, 4605, 4607, 4609, 4611, 4613, 4615, 4617, 4619, 4621, 4623, 4625, 4627, 4629, 4631, 4633, 4635, 4637, 4639, 4641, 4643, 4645, 4647, 4649, 4651, 4653, 4655, 4657, 4659, 4661, 4663, 4665, 4667, 4669, 4671, 4673, 4675, 4677, 4679, 4681, 4683, 4685, 4687, 4689, 4691, 4693, 4695, 4697, 4699, 4701, 4703, 4705, 4707, 4709, 4711, 4713, 4715, 4717, 4719, 4721, 4723, 4725, 4727, 4729, 4731, 4733, 4735, 4737, 4739, 4741, 4743, 4745, 4747, 4749, 4751, 4753, 4755, 4757, 4759, 4761, 4763, 4765, 4767, 4769, 4771, 4773, 4775, 4777, 4779, 4781, 4783, 4785, 4787, 4789, 4791, 4793, 4795, 4797, 4799, 4801, 4803, 4805, 4807, 4809, 4811, 4813, 4815, 4817, 4819, 4821, 4823, 4825, 4827, 4829, 4831, 4833, 4835, 4837, 4839, 4841, 4843, 4845, 4847, 4849, 4851, 4853, 4855, 4857, 4859, 4861, 4863, 4865, 4867, 4869, 4871, 4873, 4875, 4877, 4879, 4881, 4883, 4885, 4887, 4889, 4891, 4893, 4895, 4897, 4899, 4901, 4903, 4905, 4907, 4909, 4911, 4913, 4915, 4917, 4919, 4921, 4923, 4925, 4927, 4929, 4931, 4933, 4935, 4937, 4939, 4941, 4943, 4945, 4947, 4949, 4951, 4953, 4955, 4957, 4959, 4961, 4963, 4965, 4967, 4969, 4971, 4973, 4975, 4977, 4979, 4981, 4983, 4985, 4987, 4989, 4991, 4993, 4995, 4997, 4999, 5001, 5003, 5005, 5007, 5009, 5011, 5013, 5015, 5017, 5019, 5021, 5023, 5025, 5027, 5029, 5031, 5033, 5035, 5037, 5039, 5041, 5043, 5045, 5047, 5049, 5051, 5053, 5055, 5057, 5059, 5061, 5063, 5065, 5067, 5069, 5071, 5073, 5075, 5077, 5079, 5081, 5083, 5085, 5087, 5089, 5091, 5093, 5095, 5097, 5099, 5101, 5103, 5105, 5107, 5109, 5111, 5113, 5115, 5117, 5119, 5121, 5123, 5125, 5127, 5129, 5131, 5133, 5135, 5137, 5139, 5141, 5143, 5145, 5147, 5149, 5151, 5153, 5155, 5157, 5159, 5161, 5163, 5165, 5167, 5169, 5171, 5173, 5175, 5177, 5179, 5181, 5183, 5185, 5187, 5189, 5191, 5193, 5195, 5197, 5199, 5201, 5203, 5205, 5207, 5209, 5211, 5213, 5215, 5217, 5219, 5221, 5223, 5225, 5227, 5229, 5231, 5233, 5235, 5237, 5239, 5241, 5243, 5245, 5247, 5249, 5251, 5253, 5255, 5257, 5259, 5261, 5263, 5265, 5267, 5269, 5271, 5273, 5275, 5277, 5279, 5281, 5283, 5285, 5287, 5289, 5291, 5293, 5295, 5297, 5299, 5301, 5303, 5305, 5307, 5309, 5311, 5313, 5315, 5317, 5319, 5321, 5323, 5325, 5327, 5329, 5331, 5333, 5335, 5337, 5339, 5341, 5343, 5345, 5347, 5349, 5351, 5353, 5355, 5357, 5359, 5361, 5363, 5365, 5367, 5369, 5371, 5373, 5375, 5377, 5379, 5381, 5383, 5385, 5387, 5389, 5391, 5393, 5395, 5397, 5399, 5401, 5403, 5405, 5407, 5409, 5411, 5413, 5415, 5417, or 5419.

In some embodiments, the polynucleotide is selected from the polynucleotide sequences of SEQ ID NO: 2305; 2293; 2249; 2299; 2255; 2243; 2241; 2231; 2357; and 2237.

In some embodiments, the polynucleotide is selected from the polynucleotide sequences of SEQ ID NO: 2315; 2379; 2347; 2285; 2311; 2229; 2377; 2669; 2665; 4287; 2281; 2345; 2337; 2225; 2267; 2323; 2239; and 4585.

In some embodiments, the polynucleotide encodes an enzymatically active variant AAM polypeptide, where the polynucleotide has at least 70% sequence identity, at least 80% sequence identity, at least 85% sequence identity, at least 90% sequence identity, at least 95% sequence identity, at least 97% sequence identify, at least 98% sequence identity, or at least 99% or more sequence identity to a polynucleotide listed in the Sequence Listing disclosed herein beginning from SEQ ID NO:5.

In some embodiments, the polynucleotide encodes an enzymatically active AAM and hybridizes under defined conditions, such as moderately stringent or highly stringent conditions, to the polynucleotide sequence encoding an engineered AAM enzyme as described above, or to a complement of the polynucleotide sequence encoding the engineered AAM enzyme. The phrase "stringent hybridization" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (see, e.g., Baldino et al., *Methods Enzymology* 168: 761-777; Bolton et al., 1962, *Proc. Natl. Acad. Sci. USA* 48:1390; Bresslauer et al., 1986, *Proc. Natl. Acad. Sci USA* 83:8893-8897; Freier et al., 1986, *Proc. Natl. Acad. Sci USA* 83:9373-9377; Kierzek et al., *Biochemistry* 25:7840-7846; Rychlik et al., 1990, *Nucleic Acids Res* 18:6409-6412 (erratum, 1991, *Nucleic Acids Res* 19:698); Sambrook et al., supra); Suggs et al., 1981, In *Developmental Biology Using Purified Genes (Brown et al., eds.)*, pp. 683-693, Academic Press; and Wetmur, 1991, *Crit Rev Biochem Mol Biol* 26:227-259. All publications incorporate herein by reference).

Generally, hybridization reactions are performed under conditions of lower stringency, followed by washes of varying but higher stringency. Typically, reference to "hybridization stringency" relates to such washing conditions. The term "moderately stringent hybridization" refers to conditions that permit target-DNA to bind a complementary nucleic acid that has about 60% identity, about 75% identity, about 85% identity to the target DNA; or with greater than about 90% identity to target-polynucleotide. Exemplary moderately stringent conditions are conditions equivalent to hybridization in 50% formamide, 5× Denhart's solution, 5× SSPE, 0.2% SDS at 42° C., followed by washing in 0.2× SSPE, 0.2% SDS, at 42° C.

The term "high stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018 M NaCl at 65° C. (i.e., if a hybrid is not stable in 0.018 M NaCl at 65° C., it will not be stable under high stringency conditions, as contemplated herein). High stringency conditions can be provided, for example, by hybridization in conditions equivalent to 50% formamide, 5× Denhart's solution, 5× SSPE, 0.2% SDS at 42° C., followed by washing in 0.1× SSPE, and 0.1% SDS at 65° C. In some embodiments, the SSPE can be replaced with SSC, as provided in Sambrook, supra, for high stringency hybridization conditions as well as moderately stringent conditions. For example, for polynucleotides of at least 100 nucleotides in length, the carrier material can be washed with 15 minutes using 2×SSC, 0.2% SDS at least at 50° C. (low stringency), at least at 55° C. (medium stringency), at least at 60° C. (medium-high stringency), at least at 65° C. (high stringency), and at least at 70° C. (very high stringency).

Thus, in some embodiments, the polynucleotide encodes an enzymatically active AAM and hybridizes under defined conditions, such as moderately stringent or highly stringent conditions, to the complement of a polynucleotide sequence encoding an engineered AAM enzyme selected from the polynucleotides listed in the Sequence Listing disclosed herein, beginning from SEQ ID NO:5.

In some embodiments, the present disclosure is directed to an AAM polypeptide encoded by a polynucleotide sequence which hybridizes under high stringency conditions with the polynucleotide sequence of SEQ ID NO: 1, 3, 5, 7, 9, 11, 13, 15, 17, 19, 21, 23, 25, 27, 29, 31, 33, 35, 37, 41, 43, 45, 47 or 49; or a subsequence of at least 100 nucleotides of a polynucleotide selected from the polynucleotides of the Sequence Listing herein, beginning from SEQ ID NO:5.

In the embodiments herein, an isolated polynucleotide encoding an improved alanine 2,3-aminomutase polypeptide can be manipulated in a variety of ways to provide for expression of the polypeptide. Manipulation of the isolated polynucleotide prior to its insertion into a vector may be desirable or necessary depending on the expression vector. The techniques for modifying polynucleotides utilizing recombinant DNA methods are well known in the art. Guidance is provided in Sambrook et al., 2001, *Molecular Cloning: A Laboratory Manual*, 3rd Ed., Cold Spring Harbor Laboratory Press; and *Current Protocols in Molecular Biology*, Ausubel. F. ed., Greene Pub. Associates, 1998, updates to 2005.

In some embodiments, the present disclosure is directed to an expression vector capable of expressing the engineered AAM polypeptides disclosed herein. To obtain expression of the AAM polypeptide, the polynucleotide can be operably linked to one or more heterologous regulatory sequences that control gene expression to create a nucleic acid construct, such as an expression vector or expression cassette, as further described below. Thereafter, the resulting nucleic acid construct can be introduced into an appropriate host cell for ultimate expression of the encoded AAM polypeptide. A "nucleic acid construct" or "recombinant nucleic acid" is used herein refers to a polynucleotide, either single or double-stranded, which is isolated from a naturally occurring gene or which has been modified to contain segments of nucleic acid combined and juxtaposed in a manner that would not otherwise exist in nature. Thus, in some embodiments, the present disclosure is directed to a nucleic acid construct comprising a polynucleotide encoding an AAM polypeptide of the present disclosure.

The term "control sequence" is defined herein to include all components which are necessary or advantageous for the expression of a polypeptide of the present disclosure. Each control sequence may be native or foreign to the polynucleotide sequence encoding the polypeptide. Such control sequences include, but are not limited to, a leader, polyadenylation sequence, propeptide sequence, promoter sequence, signal peptide sequence, and transcription terminator sequence. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

The term "operably linked" is defined herein as a configuration in which a control sequence is appropriately placed at a position relative to the coding sequence of the DNA sequence such that the control sequence directs the expression of a polynucleotide and/or polypeptide.

The control sequence may be an appropriate promoter sequence. A "promoter sequence" refers to a nucleic acid sequence that is recognized by a host cell for expression of a polynucleotide comprising the coding region. The promoter sequence contains transcriptional control sequences, which mediate the expression of the polypeptide. The promoter may be any nucleic acid sequence which shows transcriptional activity in the host cell of choice including mutant, truncated, and hybrid promoters, and may be obtained from genes encoding extracellular or intracellular polypeptides, either homologous or heterologous to the host cell.

For bacterial host cells, suitable promoters for directing the transcription of the nucleic acid constructs of the present disclosure, include the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alphaamylase gene (amyQ), *Bacillus licheniformis* penicillinase gene (penP), *Bacillus subtilis* xylA and xylB genes, and prokaryotic β-lactamase gene (Villa-Kamaroff et al., 1978, *Proc Natl Acad Sci USA* 75:

3727-3731), as well as the tac promoter (DeBoer et al., 1983, *Proc Natl Acad Sci USA* 80:21-25). Additional promoters are described in "Useful proteins from recombinant bacteria" in *Scientific American*, 1980, 242:74-94; and in Sambrook et al., 1989, supra. For filamentous fungal host cells, suitable promoters for directing the transcription of the polynucleotide constructs of the present disclosure include, among others, promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus olyzae* triose phosphate isomerase), and mutant, truncated, and hybrid promoters thereof.

In a yeast host, useful promoters can be from the genes for *Porphyromonas gingivalis* enolase (ENO-I), *Porphyromonas gingivalis* galactokinase (GAL1), *Porphyromonas gingivalis* alcohol dehydrogenaselglyceraldehyde-3-phosphate dehydrogenase (ADH2IGAP), and *Porphyromonas gingivalis* 3-phosphoglycerate kinase. Other useful promoters for yeast host cells are described by Romanos et al., 1992, *Yeast* 8:423-488.

In some embodiments, the control sequence may also be a suitable transcription terminator sequence, a sequence recognized by a host cell to terminate transcription. The terminator sequence is typically operably linked to the 3' terminus of the nucleic acid sequence encoding the polypeptide. Any terminator, which is functional in the host cell of choice, may be used in the present disclosure.

Terminators for filamentous fungal host cells can be from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease.

Terminators for yeast host cells can be from the genes for *Porphyromonas gingivalis* enolase, *Porphyromonas gingivalis* cytochrome C (CYC1), and *Porphyromonas gingivalis* glyceraldehyde-3-phosphate dehydrogenase. Other useful terminators for yeast host cells are described by Romanos et al., supra.

The control sequence may also be a suitable leader sequence, a nontranslated region of an mRNA, which is important for translation by the host cell. The leader sequence is typically operably linked to the 5' terminus of the nucleic acid sequence encoding the polypeptide. Any leader sequence that is functional in the host cell of choice may be used in the present disclosure. Leader sequences for filamentous fungal host cells can be from the genes for *Aspergillus oryzae* TAKA amylase and *Aspergillus nidulans* triose phosphate isomerase. Suitable leaders for yeast host cells can be from the genes for *Porphyromonas gingivalis* enolase (ENO-I), *Porphyromonas gingivalis* 3-phosphoglycerate kinase, *Sacchuromyces cerevisiae* alpha-factor, and *Sacchuromyces cerevisiae* alcohol dehydrogenaselglyceraldehyde-3-phosphate dehydrogenase (ADHYGAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence that is functional in the host cell of choice may be used in the present disclosure. In some embodiments, polyadenylation sequences for filamentous fungal host cells can be from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are described by Guo and Sherman, 1995, *Mol Cell Biol* 5:5983-5990.

The control sequence may also be a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region.

Alternatively, the foreign signal peptide coding region may simply replace the natural signal peptide coding region in order to enhance secretion of the polypeptide. However, any signal peptide coding region that directs the expressed polypeptide into the secretory pathway of a host cell of choice may be used in the present disclosure.

Effective signal peptide coding regions for bacterial host cells can be the signal peptide coding regions from the genes for *Bacillus* NClB 11837 maltogenic amylase, *Bacillus stearothermophilus* alpha-amylase, *Bacillus licheniformis* subtilisin, *Bacillus licheniformis* β-lactamase, *Bacillus stearothermophilus* neutral proteases (nprT, nprS, nprM), and *Bacillus subtilis* prsA. Further signal peptides are described by Simonen and Palva, 1993, *Microbiol. Rev* 57:109-137, incorporated herein by reference.

Effective signal peptide coding regions for filamentous fungal host cells are the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase.

Useful signal peptides for yeast host cells are obtained from the genes for *Porphyromonas gingivalis* alpha-factor and *Porphyromonas gingivalis* invertase. Other Useful signal peptide coding regions are described by Romanos et al., 1992, supra.

The control sequence may also be a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Porphyromonas gingivalis* alpha-factor, *Rhizomucor miehei* aspartic proteinase, and *Myceliophthora thermophila* lactase (WO 95133836).

Where both signal peptide and propeptide regions are present at the amino terminus of a polypeptide, the propeptide region is positioned next to the amino-terminus of a polypeptide and the signal peptide region is positioned next to the amino terminus of the propeptide region.

It may also be desirable to add regulatory sequences, which allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include the lac, tac, and trp operator systems. In yeast host cells, suitable regulatory systems include the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter.

Other examples of regulatory sequences are those, which allow for gene amplification. In prokaryotes, these include replication mutants that result in high copy number of plasmids (e.g., runaway replication plasmids; see, e.g., Yasuda and Takagi, 1983, *J. Bacteriol.* 154(3):1153-1161). In eukaryotic systems, these include the dihydrofolate reductase gene, which is amplified in the presence of methotrexate, and the metallothionein genes, which are amplified with heavy metals. In these cases, the nucleic acid sequence encoding the AAM polypeptide of the present disclosure would be operably linked with the regulatory sequence.

7.4 Expression Vectors

As discussed above, the present disclosure is also directed to a recombinant expression vector comprising a polynucleotide encoding an engineered AMM polypeptide, and one or more expression regulating regions. An expression regulating region includes a promoter, a terminator, a replication origin, etc., depending on the type of hosts into which they are to be introduced. The various nucleic acid and control sequences described above may be joined together to produce a recombinant expression vector which may include one or more convenient restriction sites to allow for insertion or substitution of the nucleic acid sequence encoding the polypeptide at such sites. Alternatively, the nucleic acid sequence of the present disclosure may be expressed by inserting the nucleic acid sequence or a nucleic acid construct comprising the sequence into an appropriate vector for expression. In creating the expression vector, the coding sequence is located in the vectors that the coding sequence is operably linked with the appropriate control sequences for expression.

The recombinant expression vector may be any vector (e.g., a plasmid or virus), which can be conveniently subjected to recombinant DNA procedures and can bring about the expression of the polynucleotide sequence. The choice of the vector will typically depend on the compatibility of the vector with the host cell into which the vector is to be introduced. The vectors may be linear or closed circular plasmids.

The expression vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In various embodiments, the expression vector can have one or more selectable markers, which permit easy selection of transformed cells. A selectable marker is a gene the product of which provides for biocide or viral resistance, resistance to heavy metals, prototrophy to auxotrophs, and the like. Examples of bacterial selectable markers includem among others, the dal genes from *Bacillus subtilis* or *Bacillus licheniformis*, or markers, which confer antibiotic resistance such as ampicillin, kanamycin, chloramphenicol (Example 1) or tetracycline resistance. Suitable markers for yeast host cells are ADE2, HIS3, LEU2, LYS2, MET3, TRP1, and URA3.

Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Embodiments for use in an *Aspergillus* cell include the amdS and pyrG genes of *Aspergillus nidulans* or *Aspergillus oryzae* and the bar gene of *Streptomyces hygroscopicus*.

In some embodiments, the expression vectors can contain an element(s) that permits integration of the vector into the host cell's genome or autonomous replication of the vector in the cell independent of the genome. For integration into the host cell genome, the vector may rely on the nucleic acid sequence encoding the polypeptide or any other element of the vector for integration of the vector into the genome by homologous or nonhomologous recombination.

Alternatively, the vector may contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements should preferably contain a sufficient number of nucleic acids, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by nonhomologous recombination.

For autonomous replication, the vector can further comprise an origin of replication enabling the vector to replicate autonomously in the host cell in question. Examples of bacterial origins of replication are P15A, pSC101, pMB1 and ColE1. Origins of replication of plasmids pBR322 (which has a pMB1 origin of replication) pUC19 (which has a ColE1 origin of replication), pACYC177 and pACYC184 (which have a P15A origin of replication), permit replication in *E. coli*; origins of replication for plasmids pUB110, pE194, pTA1060, or pAMβ1 permit replication in *Bacillus*. Examples of origins of replication for use in a yeast host cell are the 2 micron origin of replication, ARS 1, ARS4, the combination of ARS 1 and CEN3, and the combination of ARS4 and CEN6. The origin of replication may be one having a mutation which conditional for replication (e.g., temperature-sensitive) in the host cell (see, e.g., Ehrlich et al., 1978, *Proc Natl Acad Sci USA* 75:1433).

More than one copy of a nucleic acid sequence of the present disclosure may be inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many of the expression vectors for use in the present disclosure are commercially available. Suitable commercial expression vectors include p3xFLAG™ expression vectors from Sigma-Aldrich Chemicals, St. Louis Mo., which includes a CMV promoter and hGH polyadenylation site for expression in mammalian host cells and a pBR322 origin of replication and ampicillin resistance markers for amplification in *E. coli*. Other suitable expression vectors include, among others, pBluescriptII SK(−) and pBK-CMV, which are commercially available from Stratagene, LaJolla Calif., and plasmids which are derived from pBR322 (Gibco BRL), pUC (Gibco BRL), pREP4, pCEP4 (Invitrogen) and pPoly (Lathe et al., 1987, *Gene* 57:193-201).

7.5 Host Cells for Expression of AAM

In another aspect, the present disclosure provides a host cell comprising a polynucleotide encoding an improved AAM polypeptide of the present disclosure, the polynucleotide being operatively linked to one or more control sequences for expression of the AAM enzyme in the host cell. Host cells for use in expressing the AAM polypeptides encoded by the expression vectors are well known in the art and include but are not limited to, bacterial cells, such as *E. coli, Streptomyces* and *Salmonella typhimurium* cells; fungal cells, such as yeast cells (e.g., *Porphyromonas gingivalis* or *Pichia pastoris* (ATCC Accession No. 201178)); insect cells such as *Drosophila* S2 and *Spodoptera; Sf*9 cells; animal cells such as CHO, COS, BHK, 293, and Bowes melanoma cells; and plant cells. Appropriate culture mediums and growth conditions for the above-described host cells will be apparent to the skilled artisan based on the choice of the host cell.

By way of example, a mutant *E. coli* BW25113 ΔpanD strain (Datsenko et al., 2000, *Proc Natl Acad Sci. USA* 97:6640-6645) can be transformed by an expression vector for expressing the AAM polynucleotides of the present disclosure. The expression vector is created by operably linking a polynucleotide of the present disclosure to the lac promoter under control of the lacI repressor gene. The expression vector also contains the P15A origin of replication and the chloramphenicol resistance gene. The transformed *E. coli* BW25113 ΔpanD can be readily cultured under appropriate culture medium containing chloramphenicol such that only transformed *E. coli* cells that expressed the expression vector survives. See, e.g., Example 1.

7.6 Method of Generating and Using Engineered AAM Polypeptides

To make the improved AAM polynucleotides and polypeptides of the present disclosure, the polynucleotide encoding the naturally-occurring or engineered AMM enzymes can be subjected to mutagenesis and/or directed evolution methods, as discussed above. An exemplary directed evolution technique is mutagenesis and/or DNA shuffling as described in Stemmer, 1994, *Proc Natl Acad Sci USA* 91:10747-10751; WO 95/22625; WO 97/0078; WO 97/35966; WO 98/27230; WO 00/42651; WO 01/75767; and U.S. Patent No. 6,537,746. Other directed evolution procedures that can be used include, among others, staggered extension process (StEP), in vitro recombination (Zhao et al., 1998, *Nat Biotechnol.* 16:258-261), mutagenic PCR (Caldwell et al., 1994, *PCR Methods Appl.* 3:S136-S140), cassette mutagenesis (Black et al., 1996, *Proc Natl Acad Sci USA* 93:3525-3529), and other techniques referenced previously. Any of these methods can be applied to a reference polynucleotide encoding an AAM polypeptide, including any of the polynucleotides listed in the Sequence Listing beginning from SEQ ID NO:5, to generate variants of those AAM polynucleotides. To maximize any diversity, several of the above-described techniques can be used sequentially. Typically, a library of mutant polynucleotides, such as variants polynucleotides of the AMM encoding polynucleotides disclosed herein, is created by one mutagenic or evolutionary technique, and their expression products are screened to find the polypeptide having the highest AAM activity. Then a second mutagenic or evolutionary technique is applied to polynucleotides encoding the most active polypeptides to create a second library, which in turn is screened for AAM activity by the same technique. The process of mutating and screening can be repeated as many times as needed, including the insertion of point mutations, to arrive at a polynucleotide that encodes a polypeptide with the desired improved property, such as activity, thermostabiliy, or cofactor preference.

Exemplary methods are described in further detail in the Examples. In the present disclosure, as discussed above, a series of directed evolution techniques was applied to an initial parent molecule SEQ ID NO:3, which encodes the polynucleotide of SEQ ID NO:4. International patent publication WO 03/062173 reports that SEQ ID NO: 3 was obtained by modifying the DNA of SEQ ID NO:1 (P. gingivalis KAM). *P. gingivalis* KAM (SEQ ID NO: 2), which is thus the "grandparent" molecule of the disclosure molecules described herein and is also reported to have no detectable AAM activity. Parental polypeptide (SEQ ID NO: 4) has detectable, but low alanine 2,3-aminomutase activity in the assay of Example 4.

AAM polypeptides, including variants of AAM polypeptides in the Sequence Listing, can be readily screened to ascertain whether they have AAM activity. For example, after each round of mutagenesis or directed evolution is performed, the resulting libraries of polypeptides can be screened. In some embodiments, screening for transformed cells that express a polypeptide having AAM activity can be, in general, a two-step process. First, the cells are physically separated and then screened to identify which cells do and do not possess a desired property. Selection can be a form of screening in which identification and physical separation are achieved simultaneously by expression of a selection marker, which, in some genetic circumstances, allows cells expressing the marker to survive while other cells die (or vice versa). Exemplary screening markers include luciferase, β-galactosidase, and green fluorescent protein. Selection markers include drug and toxin resistance genes, such as resistance to chloramphenicol, ampicillin, kanamycin, tetracyclin, and the like. Although spontaneous selection can and does occur in the course of natural evolution, in the present methods selection is performed by man. The cells can then be screened for production of β-alanine using any assay sufficiently sensitive for measuring β-alanine, including the assays described in the Examples. Thus, in some embodiments, the assay comprises a LC/MS/MS assay of Example 4.

Figure 2:
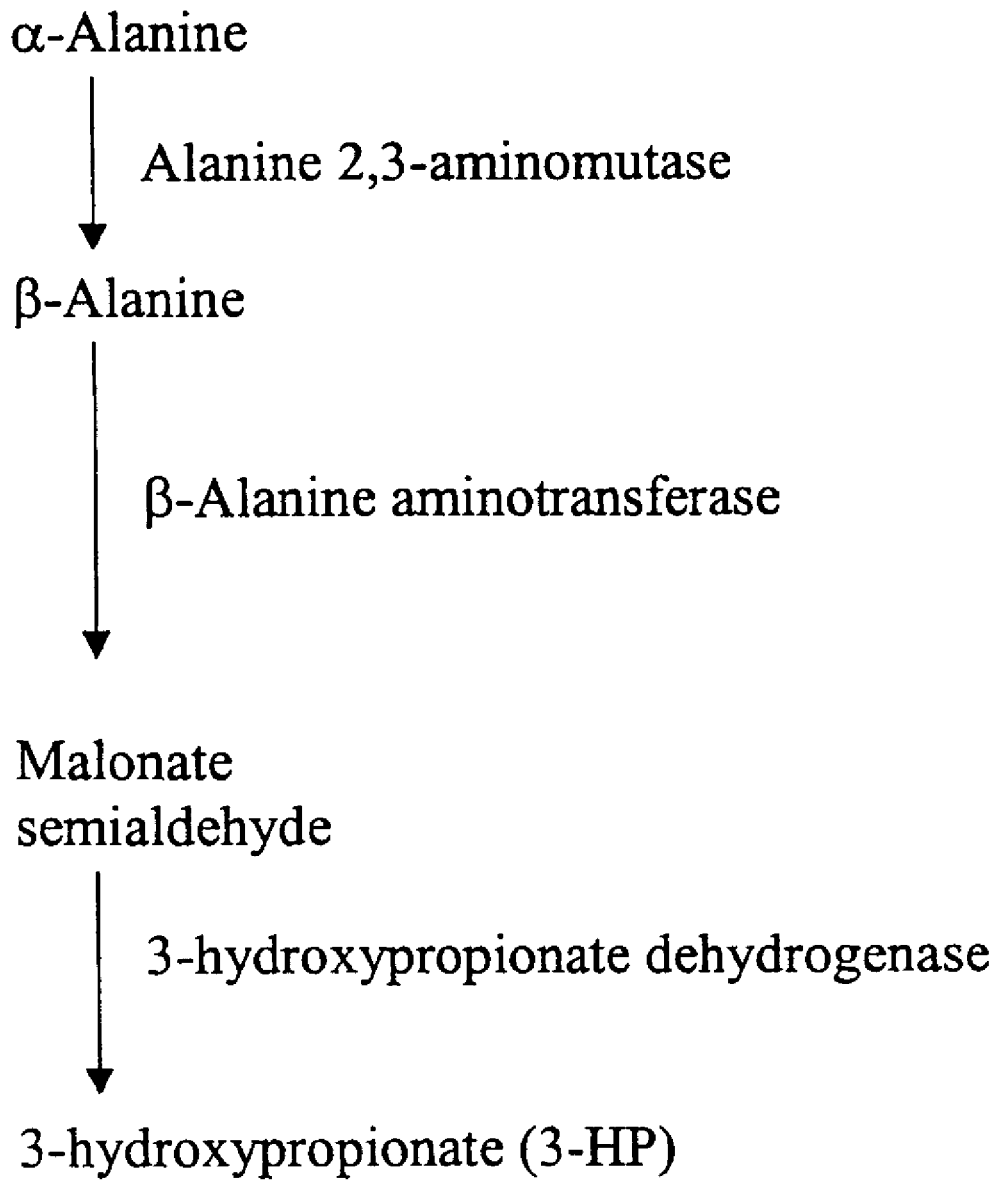
FIG. 2 is a pathway for synthesis of 3-hydroxypropionic acid (3-HP) from α-alanine, via β-alanine as an intermediate.
Figure 3:
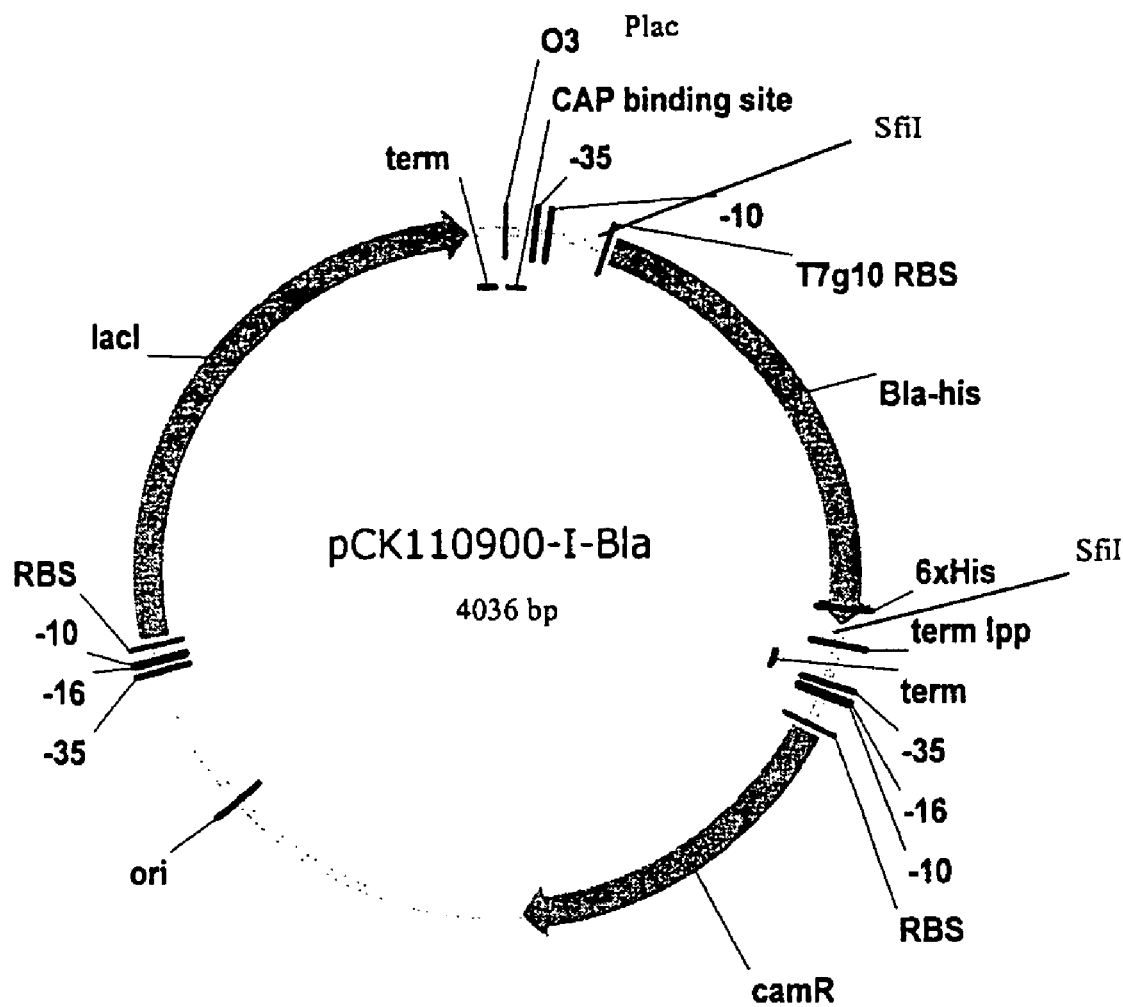
FIG. 3 is a 4036 bp expression vector (pCK110900-I Bla) comprising a P15A origin of replication (P15A ori), a lacI repressor, a CA binding site, a lac promoter (lac), a T7 ribosomal binding site (T7g10 RBS), and a chloramphenicol resistance gene (camR). 6xHis tag disclosed as SEQ ID NO: 5430.

In some embodiments, the screens for the improved AAM polypeptides can be based on measuring the ultimate products of the biochemical pathway involving AAM enzymes (see FIG. 2). Thus in some embodiments, the assay can measure the production of 3-HP. In such embodiments, the expression of enzymes involved in the pathway can be increased in a single cell to enhance the production of the substrate β-alanine as well as conversion of the product β-alanine to 3-HP. The genes encoding the other enzymes in the 3-HP pathway can be cloned into a synthetic operon, thereby allowing co-expression of the enzymes. The polynucleotide encoding the AAM polypeptide to be tested can be part of the synthetic operon or introduced in a separate expression vector. Enhancements in AAM enzyme activity can be detected by the increase in the formation of 3-HP. An exemplary assay of this type is described in Example 5, which describes the construction of the synthetic operon that includes the polynucleotide encoding the AAM polypeptide. Any standard assay for detecting 3-HP can be used. An exemplary LC/MS/MS assay is provided in Example 6. Additional descriptions of use of synthetic operons for expressing the enzymes of the 3-HP pathway are given in Jessen et al., U.S. application Ser. No. 60/824,031, entitled "Beta-Alanine/Alpha-Ketoglutarate Aminotransferase for 3-Hydroxypropionic Acid Production," filed Aug. 30, 2006, incorporated herein by reference.

If the sequence of the engineered polypeptide is known, the polynucleotides encoding the AAM enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides of the present disclosure can be prepared by chemical synthesis using, e.g., the classical phosphoramidite method described by Beaucage et al., 1981, *Tet Lett* 22:1859-69, or the method described by Matthes et al., 1984, *EMBO J.* 3:801-05, e.g., as it is typically practiced in automated synthetic methods. According to the phosphoramidite method, oligonucleotides are synthesized, e.g., in an automatic DNA synthesizer, purified, annealed, ligated and cloned in appropriate vectors. In addition, essentially any nucleic acid can be obtained from any of a variety of commercial sources, such as The Midland Certified Reagent Company, Midland, Tex., The Great American Gene Company, Ramona, Calif., ExpressGen Inc. Chicago, Ill., Operon Technologies Inc., Alameda, Calif., and many others.

In some embodiments, the polynucleotides can also be synthesized by well known techniques as described in the technical literature. See, e.g., Caruthers et al., 1992, Cold Spring Harbor Symp. Quant. Biol. 47:411-418. Double stranded DNA can then be obtained either by synthesizing the complementary strand and annealing the strands together under appropriate conditions, or by adding the complementary strand using DNA polymerase with an appropriate primer sequence.

In some embodiments, the AAM polypeptides can be synthesized by standard peptide chemistry techniques. Polypeptides may be prepared using conventional step-wise solution or solid phase synthesis (see, e.g., *Chemical Approaches to the Synthesis of Peptides and Proteins*, Williams et al., Eds., 1997, CRC Press, Boca Raton Fla., and references cited therein; *FMOC Solid Phase Peptide Synthesis: A Practical Approach*, Chan & White, Eds., 2000, IRL Press, Oxford, England, and references cited therein). In other embodiments, the polypetides may be prepared by way of segment condensation, as described, for example, in Liu et al., 1996, *Tetrahedron Lett.* 37(7):933-936; Baca et al., 1995, *J Am Chem Soc.* 117:1881-1887; Tam et al., 1995, *Int J Peptide Protein Res.* 45:209-216; Schnolzer and Kent, 1992, Science 256:221-225; Liu and Tam, 1994, *J Am Chem Soc.* 116(10): 4149-4153; Liu and Tam, 1994, *Proc Natl Acad Sci USA* 91:6584-6588; Yamashiro and Li, 1988, *Int. J. Peptide Protein Res.* 31:322-334.

Manipulation of the polynucleotides and polypeptide can follow general molecular biological techniques, such as those described in Berger and Kimmel, "Guide to Molecular Cloning Techniques," *Meth. Enzy., Volume* 152, Academic Press, Inc., San Diego, Calif.; Sambrook et al., 1989, *Molecular Cloning: A Laboratory Manual, 2$^{nd}$* Ed., Volumes 1-3, Cold Spring Harbor Laboratory Press, Cold Spring Harbor, N.Y.; and *Current Protocols in Molecular Biology*, F. M. Ausubel et al. eds., Green Publishing Associates and John Wiley & Sons, updates to 2000. Examples of techniques sufficient to direct persons of skill for in vitro amplification methods, including the polymerase chain reaction, ligase chain reaction, Qβ-replicase amplification, and other RNA polymer mediated techniques (e.g., NASBA) can be found in the references cited above (e.g., Sambrook, supra) as well as U.S. Pat. No. 4,683,202; *PCR Protocols: A Guide to Methods and Applications*, Innis et al. eds., Academic Press, Inc., San Diego, Calif. (1990), Arnheim and Levinson, 1990, *Chemical and Engineering News* 36-47; Kwoh et al., 1989, *Proc Natl Acad Sci USA* 86:1173; Guatelli et al., 1990, *Proc Natl Acad Sci USA* 87:1874; Lomell et al., 1989, *J Clin Chem.* 35:1826; Landegren et al., 1988, *Science* 241:1077-1080; Van Burnt, 1990, *Biotechnology* 8:291-294; Wu and Wallace, 1989, *Gene* 4:560; Barringer et al., 1990, *Gene* 89:117; and Sookman and Malek, 1995, *Biotechnology* 13:563-564. Improved methods of cloning in vitro amplified nucleic acid are described in U.S. Pat. No. 5,426,039. Improved methods of amplifying large nucleic acids by PCR are summarized in Cheng et al., 1994, *Nature* 369:684-685, and the references cited therein.

Engineered AAM enzymes expressed in a host cell can be recovered from the cells and or the culture medium using any one or more of the well known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, as commercially available under the trade name CelLytic B™ from Sigma-Aldrich of St. Louis Mo.

Chromatographic techniques for isolation of the AAM polypeptide include, among others, reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., and will be apparent to those having skill in the art (see, e.g., Scopes, 2006, *Protein Purification,* 3rd Ed., Springer; *Protein Purification Techniques: A Practical Approach,* 2$^{nd}$ Ed. (Roe, S. ed.) Oxford University Press (2006).

In some embodiments, affinity techniques may be used to isolate the improved AAM enzymes. For affinity chromatography purification, any antibody which specifically binds the AAM polypeptide may be used. For the production of antibodies, various host animals, including but not limited to rabbits, mice, rats, etc., may be immunized by injection with an AAM polypeptide or a fragment of the AAM polypeptide. The AAM polypeptide or its fragments may be attached to a suitable carrier, such as BSA, by means of a side chain functional group or linkers attached to a side chain functional group. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (bacilli Calmette Guerin) and *Corynebacterium parvum*.

The engineered AAM polypeptides of the present disclosure can be used in the biocatalytic route to produce 3-hydroxypropionic acid (3-HP) from β-alanine in accordance with the methods described in International patent publication WO 03/062173, which is incorporated herein by reference in its entirety.

Typically, the AAM polypeptides can be used in the form of whole cell catalysts or in as a crude preparations of the enzyme. In some embodiments, the AAM polypeptides may be isolated and further purified under anoxic conditions. For example, once the AAM polypeptides are expressed by the AAM polynucleotides in *E. coli*, the polypeptides can be extracted and purified from the cells and or the culture medium using any one or more of the well known techniques for protein purification under anoxic conditions. An exemplary process for purifying AAM polypeptides sufficiently from a cell lysate under anaerobic conditions for applications in a chemical process is disclosed in Petrovich et al., 1991, *J. Biol. Chem.* 266:7656-7660, which is incorporated herein by reference in its entirety.

The AMM polypeptide in various forms can be used to produce β-alanine. In some embodiments, the method comprises cultivating a host cell expressing an AAM polypeptide disclosed herein under conditions suitable for production of the β-alanine. Various conditions may be used for cultivating the host cell. In some embodiments, the method further comprises culturing the cell in presence of glucose under conditions suitable for the production of β-alanine. In some embodiments, the method for producing β-alanine comprises contacting a preparation of AAM polypeptide, such as a crude extract or isolated preparation of the AAM as described herein, with α-alanine under conditions suitable for conversion to β-alanine.

The methods further provide optionally recovering the β-alanine and/or using the β-alanine as a substrate in a biocatalytic pathway as described, for example in International patent publication WO 03/062173, which is incorporated by reference herein in its entirety. Conditions suitable for the production of β-alanine are described herein in Example 4, as well as in International patent publication WO 03/062173 and in Examples 5 and 7 of U.S. application Ser. No. 60/726,925, entitled "Increasing the Activity of Radical S-Adenosyl Methionine (SAM) Enzymes," filed Oct. 14, 2005, both of which examples are incorporated herein by reference for the disclosed procedures and conditions.

8. EXAMPLES

8.1 Example 1

Transformation Protocol for aam Libraries into ΔpanD KIfldA Strain

A mutant *E. coli* strain ΔpanD derived from BW25113, which is described in Datsenko et al., 2000, *Proc Natl Acad Sci USA* 97:6640-6645, was used as the host strain for screening of the aam (alanine 2,3-aminomutase) gene libraries. The protocol used to make the deletion is detailed in Example 4 of International patent publication WO 03/062173. Optimally, a strain additionally having an increased expression of the flavodoxin (fldA) gene was used as the host strain for screening of the aam gene libraries since increased flavodoxin enhances aminomutase activity when produced in *E. coli*. Description for production of β-alanine from cells that express AAM and overexpress flavodoxin are given in Examples 1-4 of U.S. application Ser. No. 60/726,925, by Liao et al., filed Oct. 14, 2005, entitled "Increasing the Activity of Radical S-Adenosyl Methionine (SAM) Enzymes," incorporated herein by reference. This same application (i.e., Liao, et al.) describes in Example 4 the construction of a strain of *E. coli* in which an artificial Plac/ara hybrid promoter was placed immediately upstream of the fldA gene. Strains carrying the artificial promoter before the fldA gene are designated KIfldA, where KI refers to "knock-in").

Competent cells of *E. coli* ΔpanD KIfldA were prepared either chemically or electrochemically using standard protocols. Competent *E. coli* ΔpanD KIfldA was removed from −80° C. frozen storage and thawed. Thereafter, it was kept on ice until used. An aliquot (100 µl per transformation) was transferred into a sterile 1.5 ml centrifuge tube. A KCM (5×) salt solution was added until the concentration in the aliquot was 1×. KCM consists of 700 mM KCl; 10 mM morpholino-propanesulphonic acid (MOPS) adjusted to pH 5.8. A 1-5 µl of the ligation mixture was added to the cells. The cells containing the ligation mixture were first incubated on ice for 30 minutes. The cells were heat shocked at 42° C. for 1 min, and subsequently incubated on ice for 2 minutes. 500 µl of SOC (Maniatis et al., 1982, *Molecular Cloning: A Laboratory Manual*, 1st Ed., pp. A.2 and A.3, Cold Spring Harbor Laboratory, Cold Spring Harbor, N.Y.) was added to the cells, and the cells were incubated at 37° C. for 1 hour with agitation. The cells were then centrifuged at 5000 rpm for 3 minutes, and the SOC was removed. Pellets were subsequently resuspended in a medium appropriate for either the complementation assay (Example 3) or the biotransformation assay (Example 4).

8.2 Example 2

Cloning of aam Genes into pCK110900-I-Bla Series Vectors

The strategy employed for cloning the alanine aminomutase genes into an inducible expression system involved the isolation of the aam gene by PCR and cloning of the PCR fragment into the SfI restriction sites downstream from a mutant lac promoter/operator system. Initially, PCR primers were designed to contain a nucleotide sequence that is specific to the 5' and 3' ends of the aam gene, as well as the Shine-Delgarno sequence of the ribosome-binding site, and the unique Sfil restriction sites. The fragment was then amplified from a template, purified and digested with the restriction endonuclease Sfil. The restriction digested PCR fragment was purified using the QIAquick PCR purification kit (Qiagen) and cloned into the S'I sites of the expression vector pCK110900-I Bla under the control of a lac promoter and lad repressor gene. The expression vector also contained the P15A origin of replication and the chloramphenicol resistance gene. Shuffled aam gene libraries were cloned by the same method. Several clones were found that expressed an active alanine 2,3-aminomutase (as per the method of Example 4) and the synthetic genes were sequenced. A polynucleotide of SEQ ID NO: 3 was used as a starting material for mutation and shuffling. SEQ ID NO: 3 has 99% nucleotide identity with the wild-type *Porphyromonas gingivalis* lysine aminomutase (SEQ ID NO: 1) (GenBank Accession No. AE017175).

8.3 Example 3

Growth of Aminomutase Variants

A. Complementation assay for colonies possessing alanine aminomutase activity. To identify genes encoding polypeptides that can perform the alanine 2,3-aminomutase reaction, an efficient screen or selection for the desired activity is needed. Therefore, a selection method was developed by recognizing that *E. coli* uses β-alanine for the synthesis of pantothenic acid, which in turn is a component of coenzyme A (CoA) and of acyl carrier protein (ACP). CoA and ACP are the predominant acyl group carriers in living organisms, and are essential for growth.

In *E. coli*, the primary route to β-alanine is from aspartate in a reaction catalyzed by aspartate decarboxylase (E.C. 4.1.1.11), which is encoded by the panD gene. A functional deletion mutation of panD (i.e., ΔpanD) results in β-alanine auxotrophy and growth inhibition, which can be alleviated by the exogenous addition of pantothenate or β-alanine, or by the production of β-alanine from another source. This method is described in International Patent Publication WO 03/062173 (see Example 4), which is incorporated herein by reference.

Transformed cell pellets (Example 1) were re-suspended in 500 µl of M9 selection medium ((Maniatis et al, supra) and incubated at 30° C. for 2-4 hours with agitation. The cells were then plated onto M9 minimal agar medium supplemented with 1% mannose, 20 µM iron citrate, 5.0 g/l α-alanine, 0.1 mM isopropyl-β-D-thiogalactoside (IPTG) (Sigma Chemical Corp., St. Louis, Mo.), 50 mM MOPS, 25 mM bicarbonate, and 30 µg/ml chloramphenicol. The plated cells were incubated at 30° C. until colonies were of sufficient size to be picked using the Q-BOT™ robot colony picker (Genetix USA, Inc, Boston Mass.).

B. Non-selective growth of aminomutase variants. In some cases, non-selective growth of aminomutase variants was a desirable alternative to the complementation assay. To accomplish this, transformed cell pellets (Example 1) were resuspended in 500 µl rich medium using glucose repression conditions (2×YT media (Yeast Extract Tryptone Medium) containing 1% glucose and 30 µg/ml chloramphenicol). Cells were then plated onto 2×YT agar medium supplemented with 30 µg/ml chloramphenicol and 1% glucose. The plated cells were incubated overnight at 30° C., and the resultant colonies were picked using the Q-BOT™ robot colony picker (Genetix USA, Inc, Boston Mass.).

8.4 Example 4

Assay for β-alanine Production

A. Sample Preparation. This assay for β-alanine production can be accomplished using either colonies from the complementation assay (Example 3A), or from colonies grown under non-selective conditions (Example 3B). Library colonies were picked with a Q BOT™-robot colony picker (Genetix USA, Inc. Boston Mass.) and grown overnight at 30° C. in liquid 2× YT media (Yeast Extract Tryptone Medium) containing 1% glucose and 30 pg/ml chloramphenicol. This culture was then diluted 10-fold into fresh 2× YT containing 30 µg/ml chloramphenicol, 20 µM ferric ammonium citrate and 10 µM pyridoxine and after 2 hours of growth at 30° C., the cultures were induced for aminomutase expression with the addition of 1 mM IPTG (isopropyl thiogalactoside). The cultures were then allowed to grow for another 5 hrs at 30° C. before pelleting by centrifugation.

The cell pellets were suspended into buffered minimal media, BMM (12.8 g/L $KH^2PO_4$; 3 g/L $Na_2HPO_4.7H_2O$; 0.5 g/L NaCl; 1 g/L $NH_4Cl$; 2 mM $MgSO_4$; 0.04 mM $CaCl_2$; 2% mannose; 1 mM IPTG; 20 µM ferric ammonium citrate; 10 µM pyridoxine; 30 µg/ml chloramphenicol; 50 mM MOPS pH 7; 25 mM sodium bicarbonate pH 9, and 200 mM α-alanine) incubated at 30° C. for 17 hours under anaerobic conditions. Those having ordinary skill in the art will appreciate that the incubation time may be varied to allow for the generation of more β-alanine product. Cell growth was monitored by measuring the OD at 600 nm. The cell load is kept constant between samples to facilitate comparison of activity. Those having ordinary skill in the art will appreciate that the cell load may be varied to allow for the generation of more β-alanine product. An aliquot of the cell suspension was diluted 1:10 fold with cold 50:50 water: methanol mixture. The final solution was subsequently filtered before subjecting to the LC/MS/MS for analysis.

This assay was used to monitor β-alanine production over time by withdrawing samples at time intervals.

B. LC/MS/MS Analysis. The quantity of β-alanine was determined using a combination of liquid chromatography and mass spectrometry.

The liquid chromatography (LC) phase was performed using an ASTEC CHIROBIOTIC™ T 4.6 cm×50 mm chiral LC column (Advanced Separation Technologies, Inc., Whippany, N.J., USA). The mobile phase consisted of two solutions: A: 0.25% aqueous acetic acid; and B: 0.25% (v/v) acetic acid in methanol. The elution was isocratic @ 0.6 ml/l minute.

The mass spectrometer (MS) analysis was performed on a Micromass Ultima Triple Quad mass spectrometer, using the following tune parameters:

Capillary: 3.5 kV; cone: 20 V; hex 1: 15 V; aperture: 1.0V; source temp: 100° C.; desolvation temp: 350° C.; cone gas: 40 L/hr; desolvation gas: 500 L/h; low mass resolution (Q1): 12; high mass resolution (Q1): 12; ion energy (Q1): 0.1; collision cell entrance: -5; collision energy: 14; exit: 1; low mass resolution (42): 15 high mass resolution (Q2): 15; ion energy (42): 3.0; multiplier: 650 V.

MS Method

| Alanine transitions | | | |
| --- | --- | --- | --- |
| Analyte | Parent Ion (m/z) | Daughter Ion (m/z) | Dwell Time (sec) |
| α-alanine | 90 | 44.7 | 0.1 |
| β-alanine | 90 | 30.2 | 0.1 |

The inter-channel delay was 0.1 seconds.

β-Alanine was quantified in rate units of µM β-alanine produced per hour. It is useful to assess relative performance of a particular AAM polypeptide to a reference polypeptide, e.g., as fold improvement. The polypeptides are typically utilized in the form of a whole cell biocatalyst (i.e., a host cell transformed with the corresponding AAM polynucleotide). Exemplary reference polypeptides are the polypeptide of SEQ ID NO: 4 and the polypeptide of SEQ ID NO: 36.

8.5 Example 5

Generation and Use of Synthetic Operons for Screening for Improved Aminomutase Activity A. Transformation and growth protocol for Pgaam libraries/*E.coli* 11303 ΔpanD-panC ΔldhA KIfldA. A mutant *E. coli* 11303 ΔpanD-C ΔldhA KIfldA was used as the host strain for screening of the aam gene libraries cloned into the context of the 3-HP operon. The protocol used for the construction of the host strain is detailed in Example 4 of the International patent publication WO 03/062173. Electroporation-competent cells of *E. coli* 11303 ΔpanD-C ΔldhA KIfldA, an *E. coli* B strain, were prepared by growing 200 ml of cells in LB in 1 L flask to $OD_{600}$~0.5. The cells were cooled in ice-water mixture for 10 min before centrifugation at 4,000 g for 10 min at 4° C. The cells were washed successively with 100, 50 and 20 ml of ice-cold 10% glycerol solution. The cells were then resuspended into a final volume of 0.8 ml 10% glycerol solution and saved at −80° C. in 100 µL aliquots until used for electroporation.

ECM 630 Electro Cell Manipulator (BTX A Division of Genetronics, Inc.) was used to electroporate cells. Electroporation-competent *E. coli* 11303 ΔpanD-C ΔldhA KIfldA were removed from −80° C. storage and thawed on ice. Thereafter, they were kept on ice until used. Electroporation cuvettes (BTX) with a 1 mm gap were also placed on ice before use. An aliquot of cells (100 µl per transformation) was transferred into a sterile 1.5 ml centrifuge tube and 1-5 µl of ligation mixture was added to the cells. Cells were electroporated using the following parameters: Voltage: 1700V; Resistor: 200 Ohm; Capacitor: 25 µF. One milliliter of SOC medium (Maniatis et al., supra) was added to the cells, and the cells were incubated at 37° C. for 1 hour with agitation.

The cells were then plated onto LB agar medium supplemented with 30 µg/ml chloramphenicol and 1% glucose. The plated cells were incubated overnight at 37° C., and the resultant colonies were picked using the Q-BOT™ robot colony picker (Genetix USA, Inc, Boston Mass.).

B. Cloning of Pgaam genes into pCEK-Pgaam-Baat-PpmmsB-Spaat vector. A synthetic operon expression vector, pCEK-Pgaam-Baat-PpmmsB-Spaat, is described in Jessen et al., U.S. application Ser. No. 60/824,031, entitled "Beta-Alanine/Alpha-Ketoglutarate Aminotransferase for 3-Hydroxypropionic Acid Production," filed Aug. 30, 2006, incorporated herein by reference. The expression vector comprises the genes Pgaam (*P. gingivalis* alanine aminomutase), Baat (β-alanine amino transferase), PpmmsB (*Pseudomomas putida* methyl-malonyl semialdehyde dehydrogenase) and Spaat (*Schizosaccharomyces pombe* glutamate-pyruvate aminotransferase) in a single operon under the control of a lac promoter.

The strategy employed for cloning alanine aminomutase gene into an inducible expression system involved PCR amplification and cloning of the PCR fragment into the NdeI-HindIII restriction sites downstream from a hybrid lac-ara promoter/operator system (or a mutant lac promoter which possesses an additional lac operator sequences and the recognition site for AraC). The PCR primers were designed to contain a nucleotide sequence that is specific to the 5' and 3' ends of the aam gene and the unique NdeI and Hindu restriction sites. The fragment was then amplified from a template, purified and digested with the restriction endonucleases NdeI and HindIII. The digested PCR fragment was purified using the QIAquick PCR purification kit (Qiagen), and cloned into the NdeI-HindIII sites of the expression vector pCEK-Pgaam-Baat-PpmmsB-Spaat under the control of a lac promoter. The expression vector also contained the ColE1 origin of replication and the kanamycin resistance gene.

Figure 4:
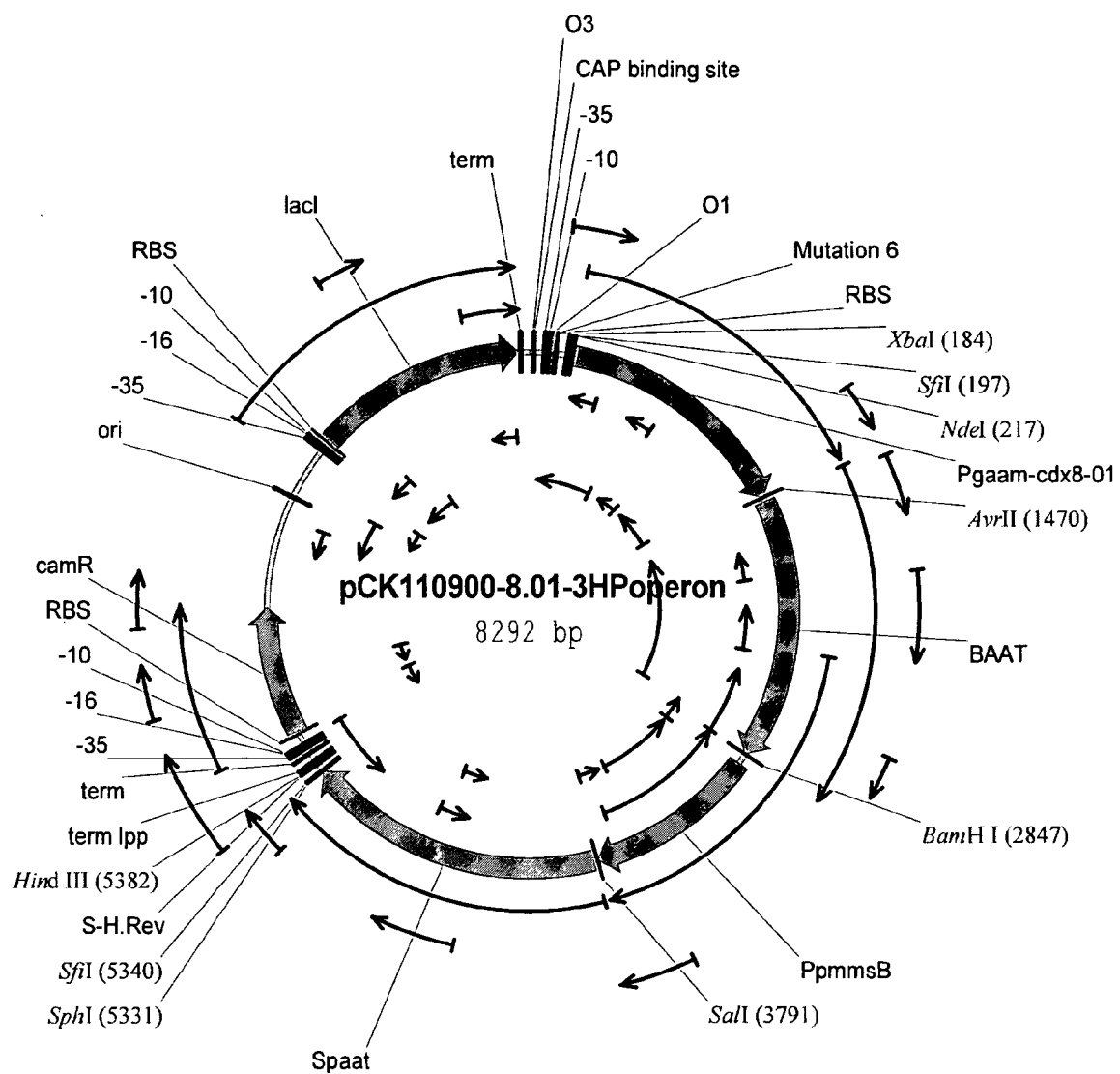
FIG. 4 shows the pCK110900 I-Bla vector with the synthetic operon of Pgaam-Baat-PpmmsB -Spaat genes used to screen for AAM polypeptides with improved enzymatic activity based on synthesis of 3-HP (see Example 5).

C. Cloning 3-HP operon into pCK110900 I-Bla vector. For better control of expression of the 3-HP pathway genes, the four pathway genes were cloned into the inducible pCK110900-I-Bla vector (see FIG. 4). The genes were assembled on a polycistronic message in the 5' to 3' order Pgaam-Baat-PpmmsB-Spaat with regions between the genes encoding ribosome binding sites (RBS). The operon was cloned downstream from the mutant lac promoter-operator system. The pCK110900-I-Bla vector contains a P15A origin of replication (low copy), lacI repressor gene, chloramphenicol resistance gene and two terminators located 3' to the pathway genes (see, e.g., WO 03/062173).

Several restriction sites were modified in order to clone the 3-HP pathway genes into the described vector. An internal SfiI site in PpmmsB was destroyed by changing K33 (AAG) to K33 (AAA), a HindIII site between Pgaam and Baat was replaced with AvrII, an XbaI between PpmmsB and Spaat was replaced with SalI, an XbaI site at 3'-end of Spaat was replaced with SphI, and SfiI sites were added to both ends of the 3-HP operon. PCR primers containing corresponding restriction site sequences were used to amplify Baat and Spaat genes from the pCEK-Pgaam-Baat-PpmmsB-Spaat vector. The Pgaam variants were amplified from pCK-Pgaam using appropriate primers. The SfiI site within mmsB was destroyed by the SOEing method (splicing by overlap extension) (Ho et al., 1999, *Gene,* 77:51-59), while at the same time new restriction sites were added to the 5' and 3' end of the gene. PCR products were cloned using TOPO TA Cloning Kit (Invitrogen Corp., Carlsbad, Calif.). Several clones of each construct were sequenced and clones with the correct sequence were taken into further cloning steps. TOPO-mmsB plasmid DNA was digested with BamHI/SalI and mmsB was ligated with the TOPO-Spaat vector digested with the same enzymes to yield TOPO-mmsB-Spaat construct. The presence of the insert was confirmed by restriction analysis. TOPO-mmsB-Spaat plasmid was digested with BamHI/SfiI and a fragment containing two genes was gel purified. Subsequently, all the genes were assembled into the operon in a four-way ligation (SfiI-Pgaam-AvrII+AvrII-Baat-BamHI+BamHI-mmsB-Spaat-SfiI+the pCK110900-I-Bla/SfiI vector) using T4 DNA ligase (New England Biolabs, Beverly, Mass.). The ligation mixture was incubated overnight at 16° C., transformed into *E. coli* XL 1-Blue (Stratagene, La Jolla, Calif.), and colonies grown on agar plates were screened by colony PCR for the presence of the full size operon. DNA was isolated from the clones exhibiting the correct sized band by PCR, and sequenced. The correct sequence was identified and the corresponding plasmids isolated. Shuffled Pgaam libraries were cloned into NdeI-AvrII sites in place of a stuffer fragment (gfp) into the context of the operon. These plasmids were subsequently transformed into *E. coli* 11303 ΔldhA ΔpanD-C KIfldA strain.

8.6 Example 6

Assay for 3-HP Production in Screens Using Synthetic Operons

A. Sample Preparation. Library colonies were picked with a QBOT™ robot colony picker (Genetix USA, Inc. Boston Mass.) and grown overnight at 30° C. in liquid LB media (Yeast Extract Tryptone Medium) containing 30 µg/ml chloramphenicol. This culture was then diluted 10-fold into fresh 2× YT containing 30 µg/ml chloramphenicol, 20 µM ferric ammonium citrate, 100 µM pyridoxine HCl and 10 µM pantothenate. After 2 hours of growth at 30° C., the cultures were induced for 3-HP pathway enzymes expression with the addition of 1 mM IPTG (isopropyl thiogalactoside). The cultures were then allowed to grow for another 6 hrs at 30° C. before pelleting the cells by centrifugation.

The cell pellets were suspended into buffered minimal media, BMM (12.8 g/L $KH_2PO_4$; 3 g/L $Na_2HPO_4$-$7H_2O$; 0.5 g/L NaCl; 20 µM ferric ammonium citrate; 100 µM pyridoxine; 5 µM pantothenate, 100 mM MOPS pH 8; 1% glucose) incubated at 30° C. for 14 hours under anaerobic conditions. Those having ordinary skill in the art will appreciate that the incubation time may be varied to allow for the generation of more 3-HP product. Cell growth was monitored by measuring the OD at 600 nm. The cell load is kept constant between samples to facilitate comparison of activity. Those having ordinary skill in the art will appreciate that the cell load may be varied to allow for the generation of more 3-HP product. An aliquot of the cell suspension was diluted 1:10 fold with 90:10 water:acetonitrile mixture. The final solution was subsequently filtered before subjecting the sample to analysis by LC/MS/MS.

This assay was used to monitor 3-HP production over time by withdrawing samples at timed intervals.

B. LC/MS/MS Analysis. The quantity of 3-HP was determined using a combination of liquid chromatography and mass spectrometry in the ESI negative ion mode. The ms/ms transitions from 89>59 represents $(3\text{-HP}-H)^- > (CH_3CO_2)^-$.

The liquid chromatography (LC) phase was performed using a Phenomenex Aqua 2.0×250 mm 5 u 125 A C18 column (Phenomenex Inc, Torrance, Calif., USA). The mobile phase consisted of two solutions: A: 98.5% of 0.1% formic acid in water and B: 1.5% acetonitrile. The elution was isocratic @ 0.4 ml/l minute.

The mass spectrometer (MS) analysis was performed on a Waters, Micromass Ultima Triple Quad mass spectrometer, using the following tune parameters:

Capillary: 3.3 kV; cone: 22 V; hex 1: 15 V; aperture: 1.0V; source temp: 100° C.; desolvation temp: 350° C.; cone gas: 47 L/hr; desolvation gas: 702 L/h; low mass resolution (Q1): 11.5; high mass resolution (Q1): 12; ion energy (Q1): 0.7; collision cell entrance: -1; collision energy: 9; exit: 1; low mass resolution (Q2): 11.5 high mass resolution (Q2): 12; ion energy (Q2): 1.1; multiplier: 650 V.

MS Method

| | 3-HP transitions | | |
|---|---|---|---|
| Analyte | Parent Ion (m/z) | Daughter Ion (m/z) | Dwell Time (sec) |
| 3-HP | 88.7 | 58.7 | 0.5 |

The inter-channel delay was 0.02 seconds.

3-HP was quantified as the total 3-HP produced (µM 3-HP produced after 14 hrs of anaerobic biotransformation.). It is useful to assess relative performance of a particular AAM polypeptide to a reference polypeptide, e.g., as fold improvement. The polypeptides are typically utilized in the form of a whole cell biocatalyst (i.e., a host cell transformed with the corresponding AAM polynucleotide).

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the disclosure(s).

SEQUENCE LISTING (5430 sequences)

SEQ ID NO: 1 - DNA, 1251 bp, Porphyromonas gingivalis
  PGAAM WT - wild type P. gingivalis lysine aminomutase, designated as Pgaam wt
  CDS (1)..(1251)
atggcagaaagtcgtagaaagtattatttccctgatgtcaccgatgagcaatggaacgactggcattggcaggtcctcaatcgaattgagacgctcgaccagctgaaaaagtacgttacactcaccgctgaagaagaagagggagtaaaagaatcgctcaaagtactccgaatggctatcacaccttattatttgagtttgatagaccccgagaatcctaattgtccgattcgtaaacaagccattcctactcatcaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtccttcctcagcgtataacgcctcaattggtggatatgctcaaaaaatatcatccggtgtggctgaacactcacttcaaccacccgaatgaagttaccgaagaagcagtagaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgctgttcctacctttgtggtagatgctccggggggtggtggtaagatacctgtaatgccgaactatgttgtatctcagtccccacgacatgtggttcttcgcaattatgaaggtgttatcacaacctatacggagccggagaattatcatgaggagtgtgattgtgaggactgtcgagccggtaagcataaagagggtgtagctgcactttccggaggtcagcagttggctatcgagccttccgacttagctcgcaaaaaacgcaagtttgataagaactga

SEQ ID NO: 2 - protein, 416 aa, Porphyromonas gingivalis
MAESRRKYYFPDVTDEQWNDWHWQVLNRIETLDQLKKYVTLTAEEEEGVKESLKVLRMAITPYYLSLIDPENPNCPIRKQAIPTHQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVDAPGGGGKIPVMPNYVVSQSPRHVVLRNYEGVITTYTEPENYHEECDCEDCRAGKHKEGVAALSGGQQLAIEPSDLARKKRKFDKN

SEQ ID NO: 3 - DNA, 1251 bp, Porphyromonas gingivalis
  P. gingivalis lysine aminomutase mutant, having AAM activity and designated as Pgaam2
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 4 - protein, 416 aa, Porphyromonas gingivalis
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 5 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgacaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcctggatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctgtgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 6 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPDNPNCPIRKQAIPTQQELVRAPEDQVDPLSEDEDSPVPGLTHRYPDRVLFLITDKCSMYCRHCTRRRFAGQKDASSPSDRLDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGCAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 7 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 8 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 9 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcctggatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 10 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERLDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 11 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgacaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 12 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLMDPDNPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 13 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactctcggctgaagaagaagagggagtaaaagaatcgcccaaagtactccgattggctatcacaccttattatttgagtttgatggaccccgacaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcctggatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 14 - protein, 416 aa, Artificial Sequence
  Description of Artificial Sequence: Synthetic Construct
MAESRRKYYFPDVTDEQWYDWHWQVLNRIKTLDQLKKYVTLSAEEEEGVKESPKVLRLAITPYYLSLMDPDNPNCPIRKQAIPTQQELVRAPEDQVDPLSEDEDSPVPGLTHRYPDRVLFLITDKCSMYCRHCTRRRFAGQKDASSPSDRLDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 15 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 16 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 17 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcctggatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 18 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSERLDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 19 - DNA, 1251 bp, Artificial Sequence; identical to SEQ ID NO: 3
  Description of Artificial Sequence: Synthetic mutant of Pgaam2 with AAM activity
  CDS (1)..(1251)

SEQ ID NO: 20 - protein, 416 aa, Artificial Sequence; identical to SEQ ID NO: 4
  Description of Artificial Sequence: Synthetic Construct

SEQ ID NO: 21 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 22 - protein, 416 aa, Artificial Sequence
  Description of Artificial Sequence: Synthetic Construct
MAESRRKYYFPDVTEEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 23 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgaggagcaatggtacgactggcattggcaggtcctcaatcgaattaagacgctcgagcagctgaaaaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 24 - protein, 416 aa, Artificial Sequence
  Description of Artificial Sequence: Synthetic Construct
MAESRRKYYFPDVSEEQWYDWHWQVLNRIKTLEQLKKYVTLTADEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 25 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgattgaagacgctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 26 - protein, 416 aa, Artificial Sequence
  Description of Artificial Sequence: Synthetic Construct
MAESRRKYYFPDVTDEQWYDWHWQVLNRLKTLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 27 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgattgaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaaatggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 28 - protein, 416 aa, Artificial Sequence
  Description of Artificial Sequence: Synthetic Construct
MAESRRKYYFPDVTDEQWYDWHWQVLNRLKTLDQLKKYVTLTAEEEEGVKESPKVLRMAITPYYLSLIDPENPNCPIRKQAIPTQQEMVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 29 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 30 - protein, 416 aa, Artificial Sequence
  Description of Artificial Sequence: Synthetic Construct
MAESRRKYYFPDVSEEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 31 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaagaacgcaagtttgataagaactaa

SEQ ID NO: 32 - protein, 416 aa, Artificial Sequence
  Description of Artificial Sequence: Synthetic Construct
MAESRRKYYFPDVTDEQWYDWHWQVLNRIKTLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKERKFDKN

SEQ ID NO: 33 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcctcaatcgattgaagagcctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 34 - protein, 416 aa, Artificial Sequence
  Description of Artificial Sequence: Synthetic Construct
MAESRRKYYFPDVSDEQWYDWHWQVLNRLKSLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 35 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 36 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 37 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcctcaatcgaattaagacgctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 38 - protein, 416 aa, Artificial Sequence
  Description of Artificial Sequence: Synthetic Construct
MAESRRKYYFPDVSDEQWYDWHWQVLNRIKTLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 39 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccgttgtggctgaacactcacttcaaccacccgaatgaagttaccgaagaagcagcggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 40 - protein, 416 aa, Artificial Sequence
  Description of Artificial Sequence: Synthetic Construct
MAESRRKYYFPDVSDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPLWLNTHFNHPNEVTEEAAEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 41 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcctcaatcgaattaagagcctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 42 - protein, 416 aa, Artificial Sequence
  Description of Artificial Sequence: Synthetic Construct
MAESRRKYYFPDVTEEQWYDWHWQVLNRIKSLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 43 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgaggagcaatggtacgactggcattggcaggtcctcaatcgaattaagagcctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 44 - protein, 416 aa, Artificial Sequence
  Description of Artificial Sequence: Synthetic Construct
MAESRRKYYFPDVSEEQWYDWHWQVLNRIKSLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 45 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcacttggaataggtcatttccgcacgccggtatctaaaggaatcgaaattatcgaaaatttgcgcggacacacctcgggctatgcagttcctacctttgtggtaggtgctccggggggtggtggcaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 46 - protein, 416 aa, Artificial Sequence; identical to SEQ ID NO: 4
  Description of Artificial Sequence: Synthetic Construct

SEQ ID NO: 47 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcctcaatcgaattaagacgctcgaccagctgaaaaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccgataagcataaagagggtgtagctgcactttccggaggtcagcagttggctatcgagccttccgacttagctcgcaaaaaacgcaagtttgataagaactaa

SEQ ID NO: 48 - protein, 416 aa, Artificial Sequence
  Description of Artificial Sequence: Synthetic Construct
MAESRRKYYFPDVSDEQWYDWHWQVLNRIKTLDQLKKYVTLTADEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRADKHKEGVAALSGGQQLAIEPSDLARKKRKFDKN

SEQ ID NO: 49 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 50 - protein, 416 aa, Artificial Sequence
  Description of Artificial Sequence: Synthetic Construct
MAESRRKYYFPDVSDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 51 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagagcctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacagacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 52 - protein, 416 aa, Artificial Sequence
  Description of Artificial Sequence: Synthetic Construct
MAESRRKYYFPDVTDEQWYDWHWQVLNRIKSLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 53 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccgaatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 54 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPNRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 55 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtaccccatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 56 - protein, 416 aa, Artificial Sequence; identical to SEQ ID NO: 16
  Description of Artificial Sequence: Synthetic Construct

SEQ ID NO: 57 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagagcctcgagcagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 58 - protein, 416 aa, Artificial Sequence
  Description of Artificial Sequence: Synthetic Construct
MAESRRKYYFPDVTDEQWYDWHWQVLNRIKSLEQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 59 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcctcaatcgaattaagacgctcgaccagctgaaaaagtacgttacactcaccgctgaagaagaagagggagtaaaagaatcgcccaaagtactccgcatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 60 - protein, 416 aa, Artificial Sequence
  Description of Artificial Sequence: Synthetic Construct
MAESRRKYYFPDVTEEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 61 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaaacccccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 62 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKETPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 63 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagagcctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 64 - protein, 416 aa, Artificial Sequence
  Description of Artificial Sequence: Synthetic Construct
MAESRRKYYFPDVTDEQWYDWHWQVLNRIKSLEQLKKYVTLTAEEEEGVKESPKVLRMAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 65 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 66 - protein, 416 aa, Artificial Sequence
  Description of Artificial Sequence: Synthetic Construct
MAESRRKYYFPDVSEEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 67 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgagcagctgaaaaagtacgttacactcaccgctgaagaagaagagggagtaagagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 68 - protein, 416 aa, Artificial Sequence
  Description of Artificial Sequence: Synthetic Construct
MAESRRKYYFPDVTDEQWYDWHWQVLNRIKTLEQLKKYVTLTAEEEEGVRESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 69 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcgccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 70 - protein, 416 aa, Artificial Sequence
  Description of Artificial Sequence: Synthetic Construct
MAESRRKYYFPDVADEQWYDWHWQVLNRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 71 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggaggttgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 72 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEVVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 73 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 74 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 75 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagagcctcgagcagctgaaaaagtacgttacactcaccgctgaagaagaagagggagtaaaagaatcgcccaaagtactccgaatggctatcaccccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 76 - protein, 416 aa, Artificial Sequence
  Description of Artificial Sequence: Synthetic Construct
MAESRRKYYFPDVTDEQWYDWHWQVLNRIKSLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 77 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgtcacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaggtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 78 - protein, 416 aa, Artificial Sequence; identical to SEQ ID NO: 74
  Description of Artificial Sequence: Synthetic Construct

SEQ ID NO: 79 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 80 - protein, 416 aa, Artificial Sequence
  Description of Artificial Sequence: Synthetic Construct
MAESRRKYYFPDVTDEQWYDWHWQVLNRIKTLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 81 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 82 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 83 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 84 - protein, 416 aa, Artificial Sequence
  Description of Artificial Sequence: Synthetic Construct
MAESRRKYYFPDVSDEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 85 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactctcggctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagtttgataagaactaa

SEQ ID NO: 86 - protein, 416 aa, Artificial Sequence
  Description of Artificial Sequence: Synthetic Construct
MAESRRKYYFPDVTDEQWYDWHWQVLNRIKTLDQLKKYVTLSADEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKLPVTPNYVVSQSPRHVVLRNYEGVITTYTEPENYHEECDCEDCRADKHKEGVAALSGGQQLAIEPSDLARKKRKFDKN

SEQ ID NO: 87 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 88 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 89 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 90 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 91 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcctcaatcgaattaagacgctcgaccagctgaaaaagtacgttacactcaccgctgaagaagaagagggagtaaaagaaacccccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 92 - protein, 416 aa, Artificial Sequence
  Description of Artificial Sequence: Synthetic Construct
MAESRRKYYFPDVTEEQWYDWHWQVLNRIKTLDQLKKYVTLTAEEEEGVKETPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 93 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcgggcacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 94 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 95 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 96 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 97 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 98 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 99 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactctcggctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagtttgataagaactaa

SEQ ID NO: 100 - protein, 416 aa, Artificial Sequence
  Description of Artificial Sequence: Synthetic Construct
MAESRRKYYFPDVTDEQWYDWHWQVINRIKTLDQLEKYVTLSADEEEGVKESPKVLRMAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRADKHKEGVAALSGGQQLAIEPSDLARKKRKFDKN

SEQ ID NO: 101 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggcgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 102 - protein, 416 aa, Artificial Sequence
  Description of Artificial Sequence: Synthetic Construct
MAESRRKYYFPDVTEEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 103 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgaggagcaatggtacgactggcattggcaggtcctcaatcgaattaagacgctcgaccagctgaaaaagtacgttacactcaccgctgaagaagaagagggagtaaaagaatcgcccaaagtgctccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 104 - protein, 416 aa, Artificial Sequence
  Description of Artificial Sequence: Synthetic Construct
MAESRRKYYFPDVSEEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 105 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 106 - protein, 416 aa, Artificial Sequence
  Description of Artificial Sequence: Synthetic Construct
MAESRRKYYFPDVTDEQWYDWHWQVLNRIKTLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 107 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 108 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 109 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctacactttccggaggtcagcagttggctatcgagccttccgacttagctcgcaaaaaacgcaagtttgataagaactaa

SEQ ID NO: 110 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVATLSGGQQLAIEPSDLARKKRKFDKN

SEQ ID NO: 111 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 112 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 113 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 114 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 115 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacccgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 116 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 117 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 118 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 119 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttggctttagagccttccgacttagctcgcaaaaaacgcaagtttgataagaactaa

SEQ ID NO: 120 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAAISGGQQLALEPSDLARKKRKFDKN

SEQ ID NO: 121 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggaatgtcgagccggtaagcataaagagggtgtagctgcactttccggaggtcagcagttggctatcgagccttccgacttagctcgcaaaaaacgcaagtttgataagaactaa

SEQ ID NO: 122 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEECRAGKHKEGVAALSGGQQLAIEPSDLARKKRKFDKN

SEQ ID NO: 123 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgctatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 124 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 125 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgatgaatgtcgagccggtaagcataaagagggtgtagctgcaatctccggaggtcagcagttggctatcgagccttccgacttagctcgcaaaaaacgcaagtttgataagaactaa

SEQ ID NO: 126 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCDECRAGKHKEGVAAISGGQQLAIEPSDLARKKRKFDKN

SEQ ID NO: 127 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 128 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 129 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttcccggatgtgaccgatgggcaatggtatgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 130 - protein, 416 aa, Artificial Sequence
  Description of Artificial Sequence: Synthetic Construct
MAESRRKYYFPDVTDGQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 131 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 132 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 133 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctctggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 134 - protein, 416 aa, Artificial Sequence; identical to SEQ ID NO: 128
  Description of Artificial Sequence: Synthetic Construct

SEQ ID NO: 135 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggagaattatcatgaggagtgcgattgtgaggactgtcgagcaggtaagcataaagagggtgtagctgcactttccggaggtcagcagttggctatcgagccttccgacttagctcgcaaaaaacgcaagtttgataagaactaa

SEQ ID NO: 136 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPITPNYVVSQSPRHVVLRNYEGVITTYTEPENYHEECDCEDCRAGKHKEGVAALSGGQQLAIEPSDLARKKRKFDKN

SEQ ID NO: 137 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatctggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 138 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHLVLRNYEGVITTYTEPENYHEECDCEDCRAGKHKEGVAALSGGQQLAIEPSDLARKKRKFDKN

SEQ ID NO: 139 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagtcggtaagcataaagagggtgtagctgcactttccggaggtcagcagttggctatcgagccttccgacttagctcgcaaaaaacgcaagtttgataagaactaa

SEQ ID NO: 140 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRVGKHKEGVAALSGGQQLAIEPSDLARKKRKFDKN

SEQ ID NO: 141 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgcagctgcactttccggaggtcagcagttggctatcgagccttccgacttagctcgcaaaaaacgcaagtttgataagaactaa

SEQ ID NO: 142 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGAAALSGGQQLAIEPSDLARKKRKFDKN

SEQ ID NO: 143 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 144 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 145 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcgaaaaacgcaagtttgataagaactaa

SEQ ID NO: 146 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLAREKRKFDKN

SEQ ID NO: 147 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtactcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccattgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttctgacttagctcgcaaaaaacgcaagtttgataagaactaa

SEQ ID NO: 148 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRTPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 149 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccagacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 150 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 151 - DNA, 1251 bp, Porphyromonas gingivalis
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 152 - protein, 416 aa, Porphyromonas gingivalis
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 153 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 154 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 155 - DNA, 1251 bp, Artificial Sequence
  Description of Artificial Sequence: Synthetic mutant of Pgaam2 with AAM activity
  CDS (1)..(1251)
atgccagaaagtcgtagaaagtatattttccctgatgtcaccgatgagcaatggtacgactgccattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 156 - protein, 416 aa, Artificial Sequence
  Description of Artificial Sequence: Synthetic Construct
MPESRRKYIFPDVTDEQWYDCHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 157 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccagatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 158 - protein, 416 aa, Artificial Sequence; identical to SEQ ID NO: 128
  Description of Artificial Sequence: Synthetic Construct

SEQ ID NO: 159 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttggtaagaactaa

SEQ ID NO: 160 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFGKN

SEQ ID NO: 161 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgctatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagatggctatcgagccttccgacttagctcgcaaaaaacgcaagttcgataagaactaa

SEQ ID NO: 162 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAAISGGQQMAIEPSDLARKKRKFDKN

SEQ ID NO: 163 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 164 - protein, 416 aa, Artificial Sequence; identical to SEQ ID NO: 152
  Description of Artificial Sequence: Synthetic Construct

SEQ ID NO: 165 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 166 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 167 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgggcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 168 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSGRIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 169 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 170 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 171 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgctatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcctggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 172 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 173 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 174 - protein, 416 aa, Artificial Sequence; identical to SEQ ID NO: 152
  Description of Artificial Sequence: Synthetic Construct

SEQ ID NO: 175 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgacgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttggctatcgagccttccgacttagctcgcaaaaaacgcaagtttgataagaactga

SEQ ID NO: 176 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAAISGGQQLAIEPSDLARKKRKFDKN

SEQ ID NO: 177 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgtgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctacactttccggaggtcagcagttggctatcgagccttccgacttagctcgcaaaaaacgcaagtttgataagaactaa

SEQ ID NO: 178 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVATLSGGQQLAIEPSDLARKKRKFDKN

SEQ ID NO: 179 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaagtcagcagttggctatcgagccttccgacttagctcgcaaaaaacgcaagtttgataagaactaa

SEQ ID NO: 180 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGSQQLAIEPSDLARKKRKFDKN

SEQ ID NO: 181 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 182 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 183 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 184 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 185 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttctgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtgcatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagtttgataagaactaa

SEQ ID NO: 186 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 187 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 188 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 189 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgctccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 190 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLLLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 191 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcccactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 192 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 193 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 194 - protein, 416 aa, Artificial Sequence
  Description of Artificial Sequence: Synthetic Construct
MAESRRKYYFPDVTDEQWYDWHWQVINRIKTLAQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 195 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 196 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 197 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcgggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 198 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDRVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 199 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 200 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 201 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 202 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACGRMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 203 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcatccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcgtaaagagggtgtagctgcactttccggaggtcagcagttggctatcgagccttccgacttagctcgcaaaaaacgcaagttcgagaagaactaa

SEQ ID NO: 204 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVHPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKRKEGVAALSGGQQLAIEPSDLARKKRKFEKN

SEQ ID NO: 205 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 206 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 207 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgctatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 208 - protein, 416 aa, Artificial Sequence; identical to SEQ ID NO: 112
  Description of Artificial Sequence: Synthetic Construct

SEQ ID NO: 209 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagactcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 210 - protein, 416 aa, Artificial Sequence
  Description of Artificial Sequence: Synthetic Construct
MAESRRKYYFPDVTDEQWYDWHWQVINRIKTLAQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 211 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 212 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 213 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgctatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcggcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 214 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVGDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 215 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgccagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgggccttccgacttagctcgcaaaaaacgcaagtttgataagaactaa

SEQ ID NO: 216 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLASDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIGPSDLARKKRKFDKN

SEQ ID NO: 217 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagactcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 218 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 219 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 220 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 221 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgctatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 222 - protein, 416 aa, Artificial Sequence; identical to SEQ ID NO: 206
  Description of Artificial Sequence: Synthetic Construct

SEQ ID NO: 223 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 224 - protein, 416 aa, Artificial Sequence; identical to SEQ ID NO: 154
  Description of Artificial Sequence: Synthetic Construct

SEQ ID NO: 225 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacactcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 226 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 227 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 228 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 229 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgctatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 230 - protein, 416 aa, Artificial Sequence; identical to SEQ ID NO: 206
  Description of Artificial Sequence: Synthetic Construct

SEQ ID NO: 231 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtgtctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 232 - protein, 416 aa, Artificial Sequence; identical to SEQ ID NO: 154
  Description of Artificial Sequence: Synthetic Construct

SEQ ID NO: 233 - DNA, 1251 bp, Artificial Sequence
  Description of Artificial Sequence: Synthetic mutant of Pgaam2 with AAM activity
  CDS (1)..(1251)
atggcagaaagtcgtagaaagtatattttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagtttgataagaactaa

SEQ ID NO: 234 - protein, 416 aa, Artificial Sequence
  Description of Artificial Sequence: Synthetic Construct
MAESRRKYIFPDVTDEQWYDWHWQVINRIKTLAQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQMAIEPSDLARKKRKFDKN

SEQ ID NO: 235 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagtttgataagaactaa

SEQ ID NO: 236 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 237 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcctctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacaccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 238 - protein, 416 aa, Artificial Sequence; identical to SEQ ID NO: 166
  Description of Artificial Sequence: Synthetic Construct

SEQ ID NO: 239 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgacgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccgcgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcggtaagaactaa

SEQ ID NO: 240 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFGKN

SEQ ID NO: 241 - DNA, 1251 bp, Artificial Sequence
  Description of Artificial Sequence: Synthetic mutant of Pgaam2 with AAM activity
  CDS (1)..(1251)
atggcagaaagtcgtagaaaggtatatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagtttgataagaactaa

SEQ ID NO: 242 - protein, 416 aa, Artificial Sequence
  Description of Artificial Sequence: Synthetic Construct
MAESRRKVYFPDVTDEQWYDWHWQVINRIKTLAQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQMAIEPSDLARKKRKFDKN

SEQ ID NO: 243 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccagtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 244 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 245 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 246 - protein, 416 aa, Artificial Sequence; identical to SEQ ID NO: 206
  Description of Artificial Sequence: Synthetic Construct

SEQ ID NO: 247 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagcctcccgacttagctcgcaaaaaacgcaagtttgataagaactaa

SEQ ID NO: 248 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPPDLARKKRKFDKN

SEQ ID NO: 249 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggtcagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgtcgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 250 - protein, 416 aa, Artificial Sequence; identical to SEQ ID NO: 112
  Description of Artificial Sequence: Synthetic Construct

SEQ ID NO: 251 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgagaagtgcgattgtgaggactgtcgagccggtaagcataaagagggtgtagctgcactttccggaggtcagcggttggctatcgagccttccgacttagctcgcaaaaaacgcaagttcgataagaactaa

SEQ ID NO: 252 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEKCDCEDCRAGKHKEGVAALSGGQRLAIEPSDLARKKRKFDKN

SEQ ID NO: 253 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgagaagaactaa

SEQ ID NO: 254 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFEKN

SEQ ID NO: 255 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttgaaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 256 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLKYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 257 - DNA, 1251 bp, Artificial Sequence
  Description of Artificial Sequence: Synthetic mutant of Pgaam2 with AAM activity
  CDS (1)..(1251)
atgcagaaaagtcgtagaaagtattatttccctgatgtcaccgatgagcaatggtacgactgcattggcagggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccctctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 258 - protein, 416 aa, Artificial Sequence
  Description of Artificial Sequence: Synthetic Construct
MQKSRRKYYFPDVTDEQWYDCIGRVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 259 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcggttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagtttgataagaactaa

SEQ ID NO: 260 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 261 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 262 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 263 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccgcgacatgtggttcttcgcaattatgaaggtgttatcacaacctatacggagccggagaattatcatgaggagtgcgattgtgaggactgccgagccggtaagcataaagagggtgtagctacactttccggaggtcagcagttggctttagagccttccgacttagctcgcaaaaaacgcaagtttgataagaactaa

SEQ ID NO: 264 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVATLSGGQQLALEPSDLARKKRKFDKN

SEQ ID NO: 265 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgccaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttggctatcgagccttccgacttagctcgcaaaaaacgcaagtttgataagaactaa

SEQ ID NO: 266 - protein, 416 aa, Artificial Sequence
  Description of Artificial Sequence: Synthetic Construct
MAESRRKYYFPDATDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAAISGGQQLAIEPSDLARKKRKFDKN

SEQ ID NO: 267 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtgcatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagtttgataagaactaa

SEQ ID NO: 268 - protein, 416 aa, Artificial Sequence; identical to SEQ ID NO: 186
  Description of Artificial Sequence: Synthetic Construct

SEQ ID NO: 269 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgccaccgatgagcaatggtacgactggcatggcagggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcctcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 270 - protein, 416 aa, Artificial Sequence
  Description of Artificial Sequence: Synthetic Construct
MAESRRKYYFPDATDEQWYDWHGRVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRLAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 271 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacaactggcattggcaggtcatcaatcgaattaagacgctcgaccagctgaaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttctgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagtttgataagaactaa

SEQ ID NO: 272 - protein, 416 aa, Artificial Sequence
  Description of Artificial Sequence: Synthetic Construct
MAESRRKYYFPDVTDEQWYNWHWQVINRIKTLDQLKKYVTLTAEEEEGVKESPKVLRLAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACGRMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 273 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagggggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggtcttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggttcacgctccggggggtggtggtaaggtacctgtaacgccgaactatgttgtatctcagtccccacgacatgtggttcttcgcaattatgaaggtgttatcacaacctatacggagccggagatttatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 274 - protein, 416 aa, Artificial Sequence
  Description of Artificial Sequence: Synthetic Construct
MAESRRKYYFPDVTDEQWYDWHWQVINRIKTLDQLEKYVTLTAEEEGGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPEIYHEECDCEDCRAGKHKEGVAALSGGQQLAIEPSDLARKKRKFDKN

SEQ ID NO: 275 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgattagctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggaggtggttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagatttatcatgaggagtgcgattgtgaggactgtcgagccggtaagcataaagagggtgtagctgcaatctccggaggtcagcagttggctctggagccttccgacttagctcgcaaaaaacgcaagtttgataagaactaa

SEQ ID NO: 276 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRLAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSNERLEYILKRLREVPHVEVVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPEIYHEECDCEDCRAGKHKEGVAAISGGQQLALEPSDLARKKRKFDKN

SEQ ID NO: 277 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgattagctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgctatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtgaaacacgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttggctctggagccttccgacttagctcgcaaaaaacgcaagtttgataagaactaa

SEQ ID NO: 278 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRLAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVKHAPGGGGKIPVTPNYVVSQSPRHVVLRNYEGVITTYTEPENYHEECDCEDCRAGKHKEGVAAISGGQQLALEPSDLARKKRKFDKN

SEQ ID NO: 279 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcgctgatgagcaatggtacgactggcattggcaggtcatcaatcgaattaagacgctcgaccagctgaaaaagtacgttacactcaccgctgaagaagaagagggagtaaaagaatcgcccaaagtactccgattagctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgctttgaatacatattgaagcgtctgcgcgaagtacctcatgtggaggtggttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgtgatctttcgcttggaatacgtcatttccgcacgccggtatctaaaggaatcgaaattatcgaaaatttgcgcggacacacctcgggctatgcagttcctacctttgtggttggggctccggggggtggtggtaagatacctgtaacgccgaactatgttgtatctcagtccccacgacatgtggttcttcgcaattatgaaggtgttatcacaacctatacggagccggagatttatcatgaggagtgcgattgtgaggactgtcgagccggtaagcataaagagggtgtagctgcaatctccggaggtcagcagttggctatcgagccttccgacttagctcgcaaaaaacgcaagtttgataagaactaa

SEQ ID NO: 280 - protein, 416 aa, Artificial Sequence
  Description of Artificial Sequence: Synthetic Construct
MAESRRKYYFPDVADEQWYDWHWQVINRIKTLDQLKKYVTLTAEEEEGVKESPKVLRLAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERFEYILKRLREVPHVEVVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPEIYHEECDCEDCRAGKHKEGVAAISGGQQLAIEPSDLARKKRKFDKN

SEQ ID NO: 281 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccccgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgattagctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggaggtggttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtgaaacaggctccggggggtggtggtaagatacctgtaacgccgaactatgttgtatctcagtccccacgacatgtggttcttcgcaattatgaaggtgttatcacaacctatacggagccggagatttatcatgaggagtgcgattgtgaggactgtcgagccggtaagcataaagagggtgtagctgcactttccggaggtcagcagttggctctggagccttccgacttagctcgcaaaaaacgcaagtttgataagaactaa

SEQ ID NO: 282 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRLAITPYYLSLIDPENPNCPIRKQAIPTQQELVRAPEDMVDPLSEDEDSPVPGLTHRYPDRVLFLMTDKCSMYCRHCTRRRFAGQKDASSPSERIDRCIDYIANTPTVRDVLLSGGDALLVSNERLEYILKRLREVPHVEVVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVKQAPGGGGKIPVTPNYVVSQSPRHVVLRNYEGVITTYTEPEIYHEECDCEDCRAGKHKEGVAALSGGQQLALEPSDLARKKRKFDKN

SEQ ID NO: 283 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcgctgatgagcaatggtacgactggcattggcaggtcatcaatcgaattaagacgctcgaccagctggaaaagtacgttacactcaccgctgaagaagaagagggagtaaaagaatcgcccaaagtactccgattagctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggaggtggttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtgaaacacgctccggggggtggtggtaagatacctgtaacgccgaactatgttgtatctcagtccccacgacatgtggttcttcgcaattatgaaggtgttatcacaacctatacggagccggagatttatcatgaggagtgcgattgtgaggactgtcgagccggtaagcataaagagggtgtagctgcaatctccggaggtcagcagttggctctggagccttccgacttagctcgcaaaaaacgcaagttcgataagaactaa

SEQ ID NO: 284 - protein, 416 aa, Artificial Sequence
  Description of Artificial Sequence: Synthetic Construct
MAESRRKYYFPDVADEQWYDWHWQVINRIKTLDQLEKYVTLTAEEEEGVKESPKVLRLAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSNERLEYILKRLREVPHVEVVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVKHAPGGGGKIPVTPNYVVSQSPRHVVLRNYEGVITTYTEPEIYHEECDCEDCRAGKHKEGVAAISGGQQLALEPSDLARKKRKFDKN

SEQ ID NO: 285 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcgctgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagatttatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 286 - protein, 416 aa, Artificial Sequence
  Description of Artificial Sequence: Synthetic Construct
MAESRRKYYFPDVADEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPEIYHEECDCEDCRAGKHKEGVAALSGGQQLAIEPSDLARKKRKFDKN

SEQ ID NO: 287 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgattagctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagatttatcatgaggagtgcgattgtgaggactgtcgagccggtaagcataaagagggtgtagctgcactttccggaggtcagcagttggctctggagccttccgacttagctcgcaaaaaacgcaagtttgataagaactaa

SEQ ID NO: 288 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRLAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPEIYHEECDCEDCRAGKHKEGVAALSGGQQLALEPSDLARKKRKFDKN

SEQ ID NO: 289 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggaggtggttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgatgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagatttatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 290 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLMDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEVVRIGSRTPVVLPQRITPQLVDMLKKYHPVWLNTHFNHPNEVTEEAVEACERMANAGIPMGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPEIYHEECDCEDCRAGKHKEGVAALSGGQQLAIEPSDLARKKRKFDKN

SEQ ID NO: 291 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatgaccgacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtgaaaggggctccggggggtggtggtaaggtagctgtaacgccgaactatgttgtatctcagtccccacgacatgtggttcttcgcaattatgaaggtgttatcacaacctatacggagccggagatttatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 292 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLMTDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVKGAPGGGGKVAVTPNYVVSQSPRHVVLRNYEGVITTYTEPEIYHEECDCEDCRAGKHKEGVAALSGGQQLALEPSDLARKKRKFDKN

SEQ ID NO: 293 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcgctgatgagcaatggtacgactggcattggcaggtcatcaatcgaattaagacgctcgaccagctggaaaagtacgttacactcaccgctgaagaagaagagggagtaaaagaatcgcccaaagtactccgattagctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 294 - protein, 416 aa, Artificial Sequence
  Description of Artificial Sequence: Synthetic Construct
MAESRRKYYFPDVADEQWYDWHWQVINRIKTLDQLEKYVTLTAEEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 295 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcgctgatgagcaatggtacgactggcattggcaggtcatcaatcgaattaagacgctcgaccagctggaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggaggtggttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggttcacgctccggggggtggtggtaaggtagctgtaacgccgaactatgttgtatctcagtccccacgacatgtggttcttcgcaattatgaaggtgttatcacaacctatacggagccggagatttatcatgaggagtgcgattgtgaggactgtcgagccggtaagcataaagagggtgtagctgcaatctccggaggtcagcagttggctctggagccttccgacttagctcgcaaaaaacgcaagtttgataagaactaa

SEQ ID NO: 296 - protein, 416 aa, Artificial Sequence
  Description of Artificial Sequence: Synthetic Construct
MAESRRKYYFPDVADEQWYDWHWQVINRIKTLDQLEKYVTLTAEEEEGVKESPKVLRLAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEVVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVAVTPNYVVSQSPRHVVLRNYEGVITTYTEPEIYHEECDCEDCRAGKHKEGVAAISGGQQLALEPSDLARKKRKFDKN

SEQ ID NO: 297 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctctgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggaggtggttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttcgctctggagccttccgacttagctcgcaaaaaacgcaagtttgataagaactaa

SEQ ID NO: 298 - protein, 416 aa, Artificial Sequence
  Description of Artificial Sequence: Synthetic Construct
MAESRRKYYFPDVSDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSNERLEYILKRLREVPHVEVVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAAISGGQQFALEPSDLARKKRKFDKN

SEQ ID NO: 299 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcgctgatgagcaatggtacgactggcattggcaggtcatcaatcgaattaagtctctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggaggtggttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttggctctggagccttccgacttagctcgcaaaaaacgcaagtttgataagaactaa

SEQ ID NO: 300 - protein, 416 aa, Artificial Sequence
  Description of Artificial Sequence: Synthetic Construct
MAESRRKYYFPDVADEQWYDWHWQVINRIKSLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEVVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAAISGGQQLALEPSDLARKKRKFDKN

SEQ ID NO: 301 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 302 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 303 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 304 - protein, 416 aa, Artificial Sequence
  Description of Artificial Sequence: Synthetic Construct
MAESRRKYYFPDVTDEQWYDWHWQVLNRIKTLDQLKKYVTLTADEEEGVKESPKVLRMAITPYYLSLIDPENPNCPIRKQAIPTQQELVRAPEDMVDPLSEDEDSPVPGLTHRYPDRVLFLMTDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 305 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactctcggctgacgaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 306 - protein, 416 aa, Artificial Sequence
  Description of Artificial Sequence: Synthetic Construct
MAESRRKYYFPDVTDEQWYDWHWQVLNRIKTLDQLKKYVTLSADEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 307 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaaacccccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 308 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKETPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 309 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 310 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 311 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcatcaatcgaattaagacgctcgaccagctgaaaaagtacgttacactcaccgctgaagaagaagagggagtaaaagaaacccccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttactatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcggaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 312 - protein, 416 aa, Artificial Sequence
  Description of Artificial Sequence: Synthetic Construct
MAESRRKYYFPDVSDEQWYDWHWQVINRIKTLDQLKKYVTLTAEEEEGVKETPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIGIIENLRGHTSGYAVPTFVVGAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 313 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactctcggctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagtttgataagaactaa

SEQ ID NO: 314 - protein, 416 aa, Artificial Sequence
  Description of Artificial Sequence: Synthetic Construct
MAESRRKYYFPDVTDEQWYDWHWQVLNRIKTLDQLKKYVTLSADEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKLPVTPNYVVSQSPRHVVLRNYEGVITTYTEPENYHEECDCEDCRADKHKEGVAALSGGQQLAIEPSDLARKKRKFDKN

SEQ ID NO: 315 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagtaccgaaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccgaggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagtttgataagaactaa

SEQ ID NO: 316 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSDRIDRCIDYIANTPTVRDVLLSGGDALLVSNERLEYILKRLREVPHVEIVRIGSRTPVVLPQRITPQLVDMLKKYHPVWLNTHFNHPNEVPKEAVEACERMANAGIPLGNQTVLLRGINDCTHVMKRLVHLLVKMRVRPYYIYVCDLSLGIGHFRTPVSKGIEIIENLRGHTSGYAVPTFVVGAPRGGGKLPVTPNYVVSQSPRHVVLRNYEGVITTYTEPENYHEECDCEDCRADKHKEGVAALSGGQQLAIEPSDLARKKRKFDKN

SEQ ID NO: 317 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactctcggctgacgaagaagagggagtaaaagaaacccccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 318 - protein, 416 aa, Artificial Sequence
  Description of Artificial Sequence: Synthetic Construct
MAESRRKYYFPDVTDEQWYDWHWQVLNRIKTLDQLKKYVTLSADEEEGVKETPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 319 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagtttgataagaactaa

SEQ ID NO: 320 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKLPVTPNYVVSQSPRHVVLRNYEGVITTYTEPENYHEECDCEDCRADKHKEGVAALSGGQQLAIEPSDLARKKRKFDKN

SEQ ID NO: 321 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactctcggctgacgaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 322 - protein, 416 aa, Artificial Sequence
  Description of Artificial Sequence: Synthetic Construct
MAESRRKYYFPDVTDEQWYDWHWQVLNRIKTLDQLKKYVTLSADEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 323 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 324 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 325 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactctcggctgacgaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 326 - protein, 416 aa, Artificial Sequence
  Description of Artificial Sequence: Synthetic Construct
MAESRRKYYFPDVTDEQWYDWHWQVLNRIKTLDQLKKYVTLSADEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 327 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagtttgataagaactaa

SEQ ID NO: 328 - protein, 416 aa, Artificial Sequence
  Description of Artificial Sequence: Synthetic Construct
MAESRRKYYFPDVTDEQWYDWHWQVLNRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKLPVTPNYVVSQSPRHVVLRNYEGVITTYTEPENYHEECDCEDCRADKHKEGVAALSGGQQLAIEPSDLARKKRKFDKN

SEQ ID NO: 329 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 330 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 331 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactctcggctgacgaagaagagggagtaaaagaaacccccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgatgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 332 - protein, 416 aa, Artificial Sequence
  Description of Artificial Sequence: Synthetic Construct
MAESRRKYYFPDVTDEQWYDWHWQVLNRIKTLDQLKKYVTLSADEEEGVKETPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 333 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagctacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 334 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKLPVTPNYVVSQSPRHVVLRNYEGVITTYTEPENYHEECDCEDCRAGKHKEGVAALSGGQQLAIEPSDLARKKRKFDKN

SEQ ID NO: 335 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgatcgcctggatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggaaatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataggaactaa

SEQ ID NO: 336 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLMTDKCSMYCRHCTRRRFAGQKDASSPSDRLDRCIEYIANTPTVRDVLLSGGDALLVSDERLEYILKRLREVPHVEIVRIGTRTPVVLPQRITPQLVEMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDRN

SEQ ID NO: 337 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcatgcctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 338 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGTRTPVVMPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 339 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcctcaatcgaattaagacgctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatattctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 340 - protein, 416 aa, Artificial Sequence
  Description of Artificial Sequence: Synthetic Construct
MAESRRKYYFPDVSDEQWYDWHWQVLNRIKTLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDILKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 341 - DNA, 1251 bp, Artificial Sequence
  Description of Artificial Sequence: Synthetic mutant of Pgaam2 with AAM activity
  CDS (1)..(1251)
atggcaaaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgatgggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagatggctatcgagccttccgacttagctcgcaaaaaacgcaagtttgataagaactaa

SEQ ID NO: 342 - protein, 416 aa, Artificial Sequence
  Description of Artificial Sequence: Synthetic Construct
MAKSRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSMGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAAISGGQQMAIEPSDLARKKRKFDKN

SEQ ID NO: 343 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagagcctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 344 - protein, 416 aa, Artificial Sequence
  Description of Artificial Sequence: Synthetic Construct
MAESRRKYYFPDVTDEQWYDWHWQVLNRIKSLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 345 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggaatgtcgagccggtaagcataaagagggtgtagctgcaatctccggaggtcagcagatggctatcgagccttccgacttagctcgcaaaaaacgcaagtttgataagaactaa

SEQ ID NO: 346 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEECRAGKHKEGVAAISGGQQMAIEPSDLARKKRKFDKN

SEQ ID NO: 347 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaagggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccagagaattatcatgaggagtgcgattgtgatgaatgtcgagccggtaagcataaagagggtgtagctgcactttccggaggtcagcagttggctatcgagccttccgacttagctcgcaaaaaacgcaagtttgataagaactaa

SEQ ID NO: 348 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCDECRAGKHKEGVAALSGGQQLAIEPSDLARKKRKFDKN

SEQ ID NO: 349 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgatgggaataggtcatttccgcacgccggtatctaaaggactggaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaagctatacggagccggacaattatcatgaggagtgcgattgtgatgaatgtcgagccggtaagcataaagagggtgtagctgcactttccggaggtcagcagttggctttagagccttccgacttagctcgcaaaaaacgcaagtttgataagaactaa

SEQ ID NO: 350 - protein, 416 aa, Artificial Sequence
  Description of Artificial Sequence: Synthetic Construct
MAESRRKYYFPDVTEEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSMGIGHFRTPVSKGLEIIENLRGHTSGYAVPTFVVHAPGGGGKIPVTPNYVVSQSPRHVVLRNYEGVITSYTEPDNYHEECDCDECRAGKHKEGVAALSGGQQLALEPSDLARKKRKFDKN

SEQ ID NO: 351 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaagctatacggagccggagaattatcatgaggagtgcgattgtgaggaatgtcgagccggtaagcataaagagggtgtagctgcaatctccggaggtcagcagatggctatcgagccttccgacttagctcgcaaaaaacgcaagtttgataagaactaa

SEQ ID NO: 352 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITSYTEPENYHEECDCEECRAGKHKEGVAAISGGQQMAIEPSDLARKKRKFDKN

SEQ ID NO: 353 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggacaattatcatgaggagtgcgattgtgatgactgtcgagccggtaagcataaagagggtgtagctgcaatctccggaggtcagcagttggctttagagccttccgacttagctcgcaaaaaacgcaagtttgataagaactaa

SEQ ID NO: 354 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPDNYHEECDCDDCRAGKHKEGVAAISGGQQLALEPSDLARKKRKFDKN

SEQ ID NO: 355 - DNA, 1251 bp, Artificial Sequence
  Description of Artificial Sequence: Synthetic mutant of Pgaam2 with AAM activity
  CDS (1)..(1251)
atggcgaaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtagcgccgaactatgttgtatctcagtccccacgacatgtggttcttcgcaattatgaaggtgttatcacaagctatacggagccggagaattatcatgaggagtgcgattgtgaggactgtcgagccggtaagcataaagagggtgtagctgcactttccggaggtcagcagatggctttagagccttccgacttagctcgcaaaaaacgcaagtttgataagaactaa

SEQ ID NO: 356 - protein, 416 aa, Artificial Sequence
  Description of Artificial Sequence: Synthetic Construct
MAKSRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVAPNYVVSQSPRHVVLRNYEGVITSYTEPENYHEECDCEDCRAGKHKEGVAALSGGQQMALEPSDLARKKRKFDKN

SEQ ID NO: 357 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagagcctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 358 - protein, 416 aa, Artificial Sequence
  Description of Artificial Sequence: Synthetic Construct
MAESRRKYYFPDVTDEQWYDWHWQVLNRIKSLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 359 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggaatgtcgagccggtaagcataaagagggtgtagctgcaatctccggaggtcagcagatggctttagagccttccgacttagctcgcaaaaaacgcaagtttgataagaactaa

SEQ ID NO: 360 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEECRAGKHKEGVAAISGGQQMALEPSDLARKKRKFDKN

SEQ ID NO: 361 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggcgttatcacaacctatacggagccggagaattatcatgaggagtgcgattgtgaggaatgtcgagccggtaagcataaagagggtgtagctgcactttccggaggtcagcagttggctatcgagccttccgacttagctcgcaaaaaacgcaagtttgataagaactaa

SEQ ID NO: 362 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEECRAGKHKEGVAALSGGQQLAIEPSDLARKKRKFDKN

SEQ ID NO: 363 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgaaccttccgacttagctcgcaaaaaacgcaagtttgataagaactaa

SEQ ID NO: 364 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 365 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 366 - protein, 416 aa, Artificial Sequence; identical to SEQ ID NO: 128
  Description of Artificial Sequence: Synthetic Construct

SEQ ID NO: 367 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttggctttagagccttccgacttagctcgcaaaaaacgcaagtttgataagaactaa

SEQ ID NO: 368 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAAISGGQQLALEPSDLARKKRKFDKN

SEQ ID NO: 369 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 370 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 371 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgtgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 372 - protein, 416 aa, Artificial Sequence; identical to SEQ ID NO: 16
  Description of Artificial Sequence: Synthetic Construct

SEQ ID NO: 373 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 374 - protein, 416 aa, Artificial Sequence; identical to SEQ ID NO: 4
  Description of Artificial Sequence: Synthetic Construct

SEQ ID NO: 375 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgtgactgtgaaggctgccgtgccggtaagcataaagagggtgtagctgcactttccggaggtcagcagttggctatcgagccttccgacttagctcgcaaaaaacgcaagtttgataagaactaa

SEQ ID NO: 376 - protein, 416 aa, Artificial Sequence
  Description of Artificial Sequence: Synthetic Construct
MAESRRKYYFPDVSDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEGCRAGKHKEGVAALSGGQQLAIEPSDLARKKRKFDKN

SEQ ID NO: 377 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagagcctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgtgactgtgaagactgccgtgccggtaagcataaagagggtgtagctgcactttccggaggtcagcagttggctatcgagccttccgacttagctcgcaaaaaacgcaagtttgataagaactaa

SEQ ID NO: 378 - protein, 416 aa, Artificial Sequence
  Description of Artificial Sequence: Synthetic Construct
MAESRRKYYFPDVTDEQWYDWHWQVLNRIKSLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 379 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaaacgtctgcgcgaaacacctcatgtggagatcgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaggatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgtgactgtgaaggctgccgtgccggtaagcataaagagggtgtagctgcactttccggaggtcagcagttggctatcgagccttccgacttagctcgcaaaaaacgcaagtttgataagaactaa

SEQ ID NO: 380 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVRMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEGCRAGKHKEGVAALSGGQQLAIEPSDLARKKRKFDKN

SEQ ID NO: 381 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 382 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 383 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 384 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 385 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttcccggatgtgaccgatgggcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatcccagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 386 - protein, 416 aa, Artificial Sequence
  Description of Artificial Sequence: Synthetic Construct
MAESRRKYYFPDVTDGQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 387 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatctggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgcggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 388 - protein, 416 aa, Artificial Sequence
  Description of Artificial Sequence: Synthetic Construct
MAESRRKYYFPDVSDEQWYDWHWQVLNRIKTLDQLKKYVTLTAEEEEGVKESPKVLRLAITPYYLSLIDPENPNCPIRKQAIPTQQELVRAPEDLVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 389 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgagcagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 390 - protein, 416 aa, Artificial Sequence
  Description of Artificial Sequence: Synthetic Construct
MAESRRKYYFPDVTDEQWYDWHWQVLNRIKTLEQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 391 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggccatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 392 - protein, 416 aa, Artificial Sequence
  Description of Artificial Sequence: Synthetic Construct
MAESRRKYYFPDVTDEQWYDWHWQVLNRIKTLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGHAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 393 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaaacgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 394 - protein, 416 aa, Artificial Sequence; identical to SEQ ID NO: 4
  Description of Artificial Sequence: Synthetic Construct

SEQ ID NO: 395 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 396 - protein, 416 aa, Artificial Sequence
  Description of Artificial Sequence: Synthetic Construct
MAESRRKYYFPDVTDEQWYDWHWQVLNRIKTLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 397 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 398 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 399 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggccatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatcccagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 400 - protein, 416 aa, Artificial Sequence
  Description of Artificial Sequence: Synthetic Construct
MAESRRKYYFPDVTEEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 401 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatctggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatgtgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacgtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 402 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLMDPENPNCPIRKQAIPTQQELVRAPEDLVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDVLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVRAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 403 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagagcctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatacttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaaacacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcatcagttggctatcgagccttccgacttagctcgcaaaaaacgcaagtttgataagaactaa

SEQ ID NO: 404 - protein, 416 aa, Artificial Sequence
  Description of Artificial Sequence: Synthetic Construct
MAESRRKYYFPDVTDEQWYDWHWQVLNRIKSLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDTSSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGHQLAIEPSDLARKKRKFDKN

SEQ ID NO: 405 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcccccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagtccctacctttgtggtacgtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 406 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVRAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 407 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgtgactgtgaaggctgccgtgccggtaagcataaagagggtgtagctgcactttccggaggtcagcagttggctatcgagccttccgacttagctcgcaaaaaacgcaagtttgataagaactaa

SEQ ID NO: 408 - protein, 416 aa, Artificial Sequence
  Description of Artificial Sequence: Synthetic Construct
MAESRRKYYFPDVSEEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEGCRAGKHKEGVAALSGGQQLAIEPSDLARKKRKFDKN

SEQ ID NO: 409 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatcttgaaacgtctgcgcgaaacacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 410 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 411 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcccaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacgtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 412 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVRAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 413 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatctggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 414 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLMDPENPNCPIRKQAIPTQQELVRAPEDLVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 415 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 416 - protein, 416 aa, Artificial Sequence
  Description of Artificial Sequence: Synthetic Construct
MAESRRKYYFPDVSEEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 417 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagagcctcgagcagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 418 - protein, 416 aa, Artificial Sequence
  Description of Artificial Sequence: Synthetic Construct
MAESRRKYYFPDVTDEQWYDWHWQVLNRIKSLEQLKKYVTLTAEEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 419 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaaacgtctgcgcgaagtacctcatgtggagatcgtacgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 420 - protein, 416 aa, Artificial Sequence; identical to SEQ ID NO: 96
  Description of Artificial Sequence: Synthetic Construct

SEQ ID NO: 421 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatctggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacgtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 422 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLMDPENPNCPIRKQAIPTQQELVRAPEDLVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVRAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 423 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaatgtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 424 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPNVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 425 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagctgtccgacttagctcgcaaaaaacgcaagtttgataagaactaa

SEQ ID NO: 426 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIELSDLARKKRKFDKN

SEQ ID NO: 427 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagatcgtacgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 428 - protein, 416 aa, Artificial Sequence; identical to SEQ ID NO: 90
  Description of Artificial Sequence: Synthetic Construct

SEQ ID NO: 429 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtcccctcgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 430 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 431 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgagcagctgaaaaagtacgttacactcaccgctgaagaagaagagggagtaaaagaaacccccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgtctggaatacatattgaagcgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 432 - protein, 416 aa, Artificial Sequence
  Description of Artificial Sequence: Synthetic Construct
MAESRRKYYFPDVTDEQWYDWHWQVLNRIKTLEQLKKYVTLTAEEEEGVKETPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 433 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgattggctatcacaccttattatttgagtttgatagaccccgagaatcctaattgtccgattcgtaaacaagccgttcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctacacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 434 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRLAITPYYLSLIDPENPNCPIRKQAVPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 435 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgaggagcaatggtacgactggcattggcaggtcctcaatcgaattaagacgcccgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 436 - protein, 416 aa, Artificial Sequence
  Description of Artificial Sequence: Synthetic Construct
MAESRRKYYFPDVSEEQWYDWHWQVLNRIKTPDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 437 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagatcgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 438 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 439 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 440 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 441 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 442 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 443 - DNA, 1251 bp, Artificial Sequence
  Description of Artificial Sequence: Synthetic mutant of Pgaam2 with AAM activity
  CDS (1)..(1251)
atggcagaaagtcgtagagagtattatttccctgatgtcaccgatgagcaatggtacgactggcattggcaggtcatcaatcgaattaagacgttcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 444 - protein, 416 aa, Artificial Sequence
  Description of Artificial Sequence: Synthetic Construct
MAESRREYYFPDVTDEQWYDWHWQVINRIKTFDQLKKYVTLTAEEEEGVKESPKVLRMAITPYYLSLMDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 445 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagatcgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 446 - protein, 416 aa, Artificial Sequence
  Description of Artificial Sequence: Synthetic Construct
MAESRRKYYFPDVTEEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 447 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagatcgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 448 - protein, 416 aa, Artificial Sequence
  Description of Artificial Sequence: Synthetic Construct
MAESRRKYYFPDVSEEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 449 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgggcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgtgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 450 - protein, 416 aa, Artificial Sequence
  Description of Artificial Sequence: Synthetic Construct
MAESRRKYYFPDVTDGQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 451 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttcccggatgtgaccgatgggcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 452 - protein, 416 aa, Artificial Sequence; identical to SEQ ID NO: 386
  Description of Artificial Sequence: Synthetic Construct

SEQ ID NO: 453 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagagcctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactacatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 454 - protein, 416 aa, Artificial Sequence; identical to SEQ ID NO: 76
  Description of Artificial Sequence: Synthetic Construct

SEQ ID NO: 455 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatctggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacgtgctccggggggtggtggtaagatacctgtaacgccgaactatgttgtatctcagtccccacgacacgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 456 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDLVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVRAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 457 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatctggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 458 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDLVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 459 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 460 - protein, 416 aa, Artificial Sequence; identical to SEQ ID NO: 30
  Description of Artificial Sequence: Synthetic Construct

SEQ ID NO: 461 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggattgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 462 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 463 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattaccatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 464 - protein, 416 aa, Artificial Sequence; identical to SEQ ID NO: 116
  Description of Artificial Sequence: Synthetic Construct

SEQ ID NO: 465 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaaacccccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 466 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKETPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 467 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatcttgaaacgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 468 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 469 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaaacacctcatgtggagatcgtacgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 470 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLMTDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 471 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaatcaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 472 - protein, 416 aa, Artificial Sequence; identical to SEQ ID NO: 154
  Description of Artificial Sequence: Synthetic Construct

SEQ ID NO: 473 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 474 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 475 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 476 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 477 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 478 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 479 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaagactgccgtgccggtaagcataaagagggtgtagctgcactttccggaggtcagcagttggctatcgagccttccgacttagctcgcaaaaaacgcaagtttgataagaactaa

SEQ ID NO: 480 - protein, 416 aa, Artificial Sequence; identical to SEQ ID NO: 22
  Description of Artificial Sequence: Synthetic Construct

SEQ ID NO: 481 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcagtcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcaccacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 482 - protein, 416 aa, Artificial Sequence
  Description of Artificial Sequence: Synthetic Construct
MAESRRKYYFPDVTDEQWYDWHWQVLSRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 483 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaaacgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 484 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 485 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtgaccgatgggcaatggtatgattggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 486 - protein, 416 aa, Artificial Sequence
  Description of Artificial Sequence: Synthetic Construct
MAESRRKYYFPDVTDGQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 487 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctggaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgccagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 488 - protein, 416 aa, Artificial Sequence
  Description of Artificial Sequence: Synthetic Construct
MAESRRKYYFPDVTDEQWYDWHWQVLNRIKTLDQLEKYVTLTAEEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLASDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 489 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatcttgaaacgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggcgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 490 - protein, 416 aa, Artificial Sequence
  Description of Artificial Sequence: Synthetic Construct
MAESRRKYYFPDVTEEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 491 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 492 - protein, 416 aa, Artificial Sequence
  Description of Artificial Sequence: Synthetic Construct
MAESRRKYYFPDVTEEQWYDWHWQVLNRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 493 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 494 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 495 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgagggctgccgtgccggtaagcataaagagggtgtagctgcactttccggaggtcagcagttggctatcgagccttccgacttagctcgcaaaaaacgcaagtttgataagaactaa

SEQ ID NO: 496 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEGCRAGKHKEGVAALSGGQQLAIEPSDLARKKRKFDKN

SEQ ID NO: 497 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 498 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 499 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgaggagcaatggtacgactggcattggcaggtcctcaatcgaattaagagcctcgagcagctgaaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 500 - protein, 416 aa, Artificial Sequence
  Description of Artificial Sequence: Synthetic Construct
MAESRRKYYFPDVSEEQWYDWHWQVLNRIKSLEQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 501 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagccctccctcagcgtataacgcctcaattggtggatatgctcaaaaaatatcatccggtgtggctgaacactcacttcaaccacccgaatgaagttaccgaagaagcagtggaggtttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 502 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVALPQRITPQLVDMLKKYHPVWLNTHFNHPNEVTEEAVEVCERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 503 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtgaccgatgagcaatggtacgactggcattggcaggtcctcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 504 - protein, 416 aa, Artificial Sequence
  Description of Artificial Sequence: Synthetic Construct
MAESRRKYYFPDVTDEQWYDWHWQVLNRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLMTDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 505 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagagcctcgagcagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 506 - protein, 416 aa, Artificial Sequence
  Description of Artificial Sequence: Synthetic Construct
MAESRRKYYFPDVTDEQWYDWHWQVLNRIKSLEQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 507 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 508 - protein, 416 aa, Artificial Sequence
  Description of Artificial Sequence: Synthetic Construct
MAESRRKYYFPDVSDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 509 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgtgactgtgaaggctgccgtgccggtaagcataaagagggtgtagctgcactttccggaggtcagcagttggctatcgagccttccgacttagctcgcaaaaaacgcaagtttgataagaactaa

SEQ ID NO: 510 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLMTDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEGCRAGKHKEGVAALSGGQQLAIEPSDLARKKRKFDKN

SEQ ID NO: 511 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatgacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 512 - protein, 416 aa, Artificial Sequence; identical to SEQ ID NO: 370
  Description of Artificial Sequence: Synthetic Construct

SEQ ID NO: 513 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgtgactgtgaaggctgccgtgccggtaagcataaagagggtgtagctgcactttccggaggtcagcagttggctatcgagccttccgacttagctcgcaaaaaacgcaagtttgataagaactaa

SEQ ID NO: 514 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEGCRAGKHKEGVAALSGGQQLAIEPSDLARKKRKFDKN

SEQ ID NO: 515 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggaggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 516 - protein, 416 aa, Artificial Sequence; identical to SEQ ID NO: 4
  Description of Artificial Sequence: Synthetic Construct

SEQ ID NO: 517 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcagcagttggctatcgagccttccgacttagctcgcaaaaaacgcaagtttgataagaactaa

SEQ ID NO: 518 - protein, 416 aa, Artificial Sequence; identical to SEQ ID NO: 4
  Description of Artificial Sequence: Synthetic Construct

SEQ ID NO: 519 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaaacacctcatgtggagatcgtacgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 520 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 521 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtctccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 522 - protein, 416 aa, Artificial Sequence
  Description of Artificial Sequence: Synthetic Construct
MAESRRKYYFPDVSDEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 523 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 524 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 525 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgaggagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacggcatgtggttcttcgcaattatgaaggtgttatcacaacctatacggagccggagaattatcatgaggagtgtgactgtgaagactgtcgagccggtaagcataaagagggtgtagctgcactttccggaggtcagcagttggctatcgagccttccgacttagctcgcaaaaaacgcaagtttgataagaactaa

SEQ ID NO: 526 - protein, 416 aa, Artificial Sequence; identical to SEQ ID NO: 22
  Description of Artificial Sequence: Synthetic Construct

SEQ ID NO: 527 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctcccccagcgaataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 528 - protein, 416 aa, Artificial Sequence; identical to SEQ ID NO: 4
  Description of Artificial Sequence: Synthetic Construct

SEQ ID NO: 529 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatcttgaaacgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 530 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 531 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaaacgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 532 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 533 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaaacccccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 534 - protein, 416 aa, Artificial Sequence; identical to SEQ ID NO: 466
  Description of Artificial Sequence: Synthetic Construct

SEQ ID NO: 535 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagcacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 536 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREAPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 537 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 538 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 539 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatctggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagcacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacgtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 540 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDLVDPLSEDEDSPVPGLTHRYPDRVLFLITDKCSMYCRHCTRRRFAGQKDASSPSERIDRCIDYIANTPTVRDVLLSGGDALLVSDERLEYILKRLREAPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVRAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 541 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 542 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 543 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaaacgtctgcgcgaaacacctcatgtggagatcgtacgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 544 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSNERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 545 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacacccaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggtataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 546 - protein, 416 aa, Artificial Sequence
  Description of Artificial Sequence: Synthetic Construct
MAESRRKYYFPDVTDEQWYDWHWQVLNRIKTLDQLKKYVTPTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 547 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgagcagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaaacgtctgcgcgaagtacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 548 - protein, 416 aa, Artificial Sequence; identical to SEQ ID NO: 396
  Description of Artificial Sequence: Synthetic Construct

SEQ ID NO: 549 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatcttgaaacgtctgcgcgaaacacctcatgtggagatcgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaatgccgaactatgttgtatctcagtccccacgacatgtggttcttcgcaattatgaaggtgttatcacaacctatacggagccggagaattatcatgaggagtgtgactgtgaaggctgccgtgccggtaagcataaagagggtgtagctgcactttccggaggtcagcagttggctatcgagccttccgacttagctcgcaaaaaacgcaagtttgataagaactaa

SEQ ID NO: 550 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLRETPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVMPNYVVSQSPRHVVLRNYEGVITTYTEPENYHEECDCEGCRAGKHKEGVAALSGGQQLAIEPSDLARKKRKFDKN

SEQ ID NO: 551 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtgaccgatgggcaatggtatgattggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctacactttccggaggtcagcagttggctatcgagccttccgacttagctcgcaaaaaacgcaagtttgataagaactaa

SEQ ID NO: 552 - protein, 416 aa, Artificial Sequence
  Description of Artificial Sequence: Synthetic Construct
MAESRRKYYFPDVTDGQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVATLSGGQQLAIEPSDLARKKRKFDKN

SEQ ID NO: 553 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcctcaatcgaattaagacgctcgaccagctgaaaaagtacgttacactcaccgctgaagaagaagagggagtaaaagaatcgcccaaagtactccgattggctatcacaccttattatttgagtttgatggaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 554 - protein, 416 aa, Artificial Sequence
  Description of Artificial Sequence: Synthetic Construct
MAESRRKYYFPDVTDEQWYDWHWQVLNRIKTLDQLKKYVTLTAEEEEGVKESPKVLRLAITPYYLSLMDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 555 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagtgaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 556 - protein, 416 aa, Artificial Sequence; identical to SEQ ID NO: 384
  Description of Artificial Sequence: Synthetic Construct

SEQ ID NO: 557 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaaacgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttatatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 558 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVISQSPRHVVLRNYEGVITTYTEPENYHEECDCEDCRAGKHKEGVAALSGGQQLAIEPSDLARKKRKFDKN

SEQ ID NO: 559 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctacgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 560 - protein, 416 aa, Artificial Sequence; identical to SEQ ID NO: 128
  Description of Artificial Sequence: Synthetic Construct

SEQ ID NO: 561 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagcggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 562 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAAEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 563 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcatagagagggtgtagctgcactttccggaggtcagcagttggctatcgagccttccgacttagctcgcaaaaaacgcaagtttgataagaactaa

SEQ ID NO: 564 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHREGVAALSGGQQLAIEPSDLARKKRKFDKN

SEQ ID NO: 565 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgactgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 566 - protein, 416 aa, Artificial Sequence; identical to SEQ ID NO: 128
  Description of Artificial Sequence: Synthetic Construct

SEQ ID NO: 567 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacggcatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 568 - protein, 416 aa, Artificial Sequence; identical to SEQ ID NO: 128
  Description of Artificial Sequence: Synthetic Construct

SEQ ID NO: 569 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaggatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 570 - protein, 416 aa, Artificial Sequence; identical to SEQ ID NO: 128
  Description of Artificial Sequence: Synthetic Construct

SEQ ID NO: 571 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcatgaagagggtgtagctgcactttccggaggtcagcagttggctatcgagccttccgacttagctcgcaaaaaacgcaagtttgataagaactaa

SEQ ID NO: 572 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHEEGVAALSGGQQLAIEPSDLARKKRKFDKN

SEQ ID NO: 573 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtaggtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 574 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVGAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 575 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 576 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVAPNYVVSQSPRHVVLRNYEGVITTYTEPENYHEECDCEDCRAGKHKEGVAALSGGQQLAIEPSDLARKKRKFDKN

SEQ ID NO: 577 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagagtcgcccaaagtactccgaatggctatcacaccttattatttgagtttgatagaccccgagaatcctaattgtccgattcgcaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 578 - protein, 416 aa, Artificial Sequence; identical to SEQ ID NO: 128
  Description of Artificial Sequence: Synthetic Construct

SEQ ID NO: 579 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcggccagctggaaaagtacgttacactcaccgctgaagaagaagagggagtaaaagaatcgcccaaagtactccgaatggctatcacaccttattatttgagtttgatagaccccgaggatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 580 - protein, 416 aa, Artificial Sequence
  Description of Artificial Sequence: Synthetic Construct
MAESRRKYYFPDVTDEQWYDWHWQVINRIKTLGQLEKYVTLTAEEEEGVKESPKVLRMAITPYYLSLIDPEDPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 581 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtacacgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaacgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 582 - protein, 416 aa, Artificial Sequence; identical to SEQ ID NO: 128
  Description of Artificial Sequence: Synthetic Construct

SEQ ID NO: 583 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 584 - protein, 416 aa, Artificial Sequence; identical to SEQ ID NO: 128
  Description of Artificial Sequence: Synthetic Construct

SEQ ID NO: 585 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatgtatgtatgcgatctttcgcttggaatacgtcatttccgcacgccggtatctaaaggaatcgaaattatcgaaaatttgcgcggacacacctcgggctatgcagttcctacctttgtggtacatgcgccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 586 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYMYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 587 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgcgccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 588 - protein, 416 aa, Artificial Sequence; identical to SEQ ID NO: 128
  Description of Artificial Sequence: Synthetic Construct

SEQ ID NO: 589 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcactggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtaccgcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 590 - protein, 416 aa, Artificial Sequence; identical to SEQ ID NO: 128
  Description of Artificial Sequence: Synthetic Construct

SEQ ID NO: 591 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcccgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttactgcgtggaatcaatgattgtacacatgtgatgaagagattggtacatttgctggtaaagatgcgtgtgcgtccttactatatatatgtatgcgatctttcgctcggaatacgtcatttccgcacgccggtatctaaaggaatcgaaattatcgaaaatttgcgcggacacacctcgggctatgcagttcctacctttgtggtacatgcgccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 592 - protein, 416 aa, Artificial Sequence; identical to SEQ ID NO: 128
  Description of Artificial Sequence: Synthetic Construct

SEQ ID NO: 593 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatactcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 594 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDILKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 595 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacacaagtttgataagaactaa

SEQ ID NO: 596 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKHKFDKN

SEQ ID NO: 597 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttctgacttagctcgcaaaaaacgcaagtttgataagaactaa

SEQ ID NO: 598 - protein, 416 aa, Artificial Sequence; identical to SEQ ID NO: 128
  Description of Artificial Sequence: Synthetic Construct

SEQ ID NO: 599 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaggatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 600 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 601 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtgtgtcatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 602 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVCHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 603 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaagtttgcgcggacacacctcgggctatgcagttcctacctttgtggtacatgctccggggggtggtggtaagataccggtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 604 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIESLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 605 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcggattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 606 - protein, 416 aa, Artificial Sequence; identical to SEQ ID NO: 128
  Description of Artificial Sequence: Synthetic Construct

SEQ ID NO: 607 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 608 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLAIEPSDLARKKRKFDKN

SEQ ID NO: 609 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctcttacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 610 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPLTPNYVVSQSPRHVVLRNYEGVITTYTEPENYHEECDCEDCRAGKHKEGVAALSGGQQLAIEPSDLARKKRKFDKN

SEQ ID NO: 611 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctctgacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 612 - protein, 416 aa, Artificial Sequence; identical to SEQ ID NO: 610
  Description of Artificial Sequence: Synthetic Construct

SEQ ID NO: 613 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgttacgccgaactatgttgtatctcagtccccacgacatgtggttcttcgcaattatgaaggtgttatcacaacctatacggagccggagaattatcatgaggagtgcgattgtgaggactgccgagccggtaagcataaagagggtgtagctgcactttccggaggtcagcagttggctatcgagccttccgacttagctcgcaaaaaacgcaagtttgataagaactaa

SEQ ID NO: 614 - protein, 416 aa, Artificial Sequence; identical to SEQ ID NO: 128
  Description of Artificial Sequence: Synthetic Construct

SEQ ID NO: 615 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctgtgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 616 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTCVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 617 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 618 - protein, 416 aa, Artificial Sequence; identical to SEQ ID NO: 128
  Description of Artificial Sequence: Synthetic Construct

SEQ ID NO: 619 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctttgacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagcacgcaaaaaacgcaagtttgataagaactaa

SEQ ID NO: 620 - protein, 416 aa, Artificial Sequence; identical to SEQ ID NO: 610
  Description of Artificial Sequence: Synthetic Construct

SEQ ID NO: 621 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttctgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtaactgcactttccggaggtcagcagttggctatcgagccttccgacttagctcgcaaaaaacgcaagtttgataagaactaa

SEQ ID NO: 622 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVTALSGGQQLAIEPSDLARKKRKFDKN

SEQ ID NO: 623 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattccaactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 624 - protein, 416 aa, Artificial Sequence; identical to SEQ ID NO: 128
  Description of Artificial Sequence: Synthetic Construct

SEQ ID NO: 625 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctacacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 626 - protein, 416 aa, Artificial Sequence; identical to SEQ ID NO: 128
  Description of Artificial Sequence: Synthetic Construct

SEQ ID NO: 627 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcacccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctcttacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 628 - protein, 416 aa, Artificial Sequence; identical to SEQ ID NO: 610
  Description of Artificial Sequence: Synthetic Construct

SEQ ID NO: 629 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgtggtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 630 - protein, 416 aa, Artificial Sequence; identical to SEQ ID NO: 128
  Description of Artificial Sequence: Synthetic Construct

SEQ ID NO: 631 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagcactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatcttgtatctcagtccccacgacatgtggttcttcgcaattatgaaggtgttatcacaacctatacggagccggagaattatcatgaggagtgcgattgtgaggactgtcgagccggtaggcataaagagggtgtagctgcactttccggaggtcagcagttggctatcgagccttccgacttagctcgcaaaaaacgcaagtttgataagaactaa

SEQ ID NO: 632 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKALRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYLVSQSPRHVVLRNYEGVITTYTEPENYHEECDCEDCRAGRHKEGVAALSGGQQLAIEPSDLARKKRKFDKN

SEQ ID NO: 633 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttctatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatctggtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 634 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYLVSQSPRHVVLRNYEGVITTYTEPENYHEECDCEDCRAGKHKEGVAALSGGQQLAIEPSDLARKKRKFDKN

SEQ ID NO: 635 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatacgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 636 - protein, 416 aa, Artificial Sequence; identical to SEQ ID NO: 128
  Description of Artificial Sequence: Synthetic Construct

SEQ ID NO: 637 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatatggtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccctccgacttagctcgcaaaaaacgcaagtttgataagaactaa

SEQ ID NO: 638 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYMVSQSPRHVVLRNYEGVITTYTEPENYHEECDCEDCRAGKHKEGVAALSGGQQLAIEPSDLARKKRKFDKN

SEQ ID NO: 639 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatatggtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 640 - protein, 416 aa, Artificial Sequence; identical to SEQ ID NO: 638
  Description of Artificial Sequence: Synthetic Construct

SEQ ID NO: 641 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagcctaccgacttagctcgcaaaaaacgcaagtttgataagaactaa

SEQ ID NO: 642 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPTDLARKKRKFDKN

SEQ ID NO: 643 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtctgataagaactaa

SEQ ID NO: 644 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKSDKN

SEQ ID NO: 645 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgaataggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 646 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 647 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaacaggcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaagggatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 648 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEQAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 649 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 650 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLRGVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 651 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagccgcactttccggaggtcagcagttggctatcgagccttccgacttagctcgcaaaaaacgcaagttcgataagaactaa

SEQ ID NO: 652 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 653 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaggaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 654 - protein, 416 aa, Artificial Sequence; identical to SEQ ID NO: 652
  Description of Artificial Sequence: Synthetic Construct

SEQ ID NO: 655 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 656 - protein, 416 aa, Artificial Sequence; identical to SEQ ID NO: 652
  Description of Artificial Sequence: Synthetic Construct

SEQ ID NO: 657 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaatgtgcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagtccctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 658 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTECAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 659 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatccagattatcgaaaatttgcgcggacacacctcgggctatgcagttcctacctttgtggtacatgctccggggggtggtggcaagatacctgtaacgccgaactatgttgtatctcagtccccacgacatgtggttcttcgcaattatgaaggtgttatcacaacctatacggagccggaaaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 660 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIQIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 661 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgagattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 662 - protein, 416 aa, Artificial Sequence; identical to SEQ ID NO: 652
  Description of Artificial Sequence: Synthetic Construct

SEQ ID NO: 663 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacccgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 664 - protein, 416 aa, Artificial Sequence; identical to SEQ ID NO: 652
  Description of Artificial Sequence: Synthetic Construct

SEQ ID NO: 665 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagctggctatcgagccttccgacttagctcgcaaaaaacgcaagtttgataagaactaa

SEQ ID NO: 666 - protein, 416 aa, Artificial Sequence; identical to SEQ ID NO: 128
  Description of Artificial Sequence: Synthetic Construct

SEQ ID NO: 667 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctacccaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacccttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 668 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTLVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 669 - DNA, 1251 bp, Artificial Sequence
  Description of Artificial Sequence: Synthetic mutant of Pgaam2 with AAM activity
  CDS (1)..(1251)
atggcagaaagtcgtaggaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcatagagagggtgtagctgcactttccggaggtcagcagttggctatcgagccttccgacttagctcgcaaaaaacgcaagttcgataagaactaa

SEQ ID NO: 670 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHREGVAALSGGQQLAIEPSDLARKKRKFDKN

SEQ ID NO: 671 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatggggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 672 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHGECDCEDCRAGKHKEGVAALSGGQQLAIEPSDLARKKRKFDKN

SEQ ID NO: 673 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcacccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgtgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 674 - protein, 416 aa, Artificial Sequence; identical to SEQ ID NO: 652
  Description of Artificial Sequence: Synthetic Construct

SEQ ID NO: 675 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctcccccagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 676 - protein, 416 aa, Artificial Sequence; identical to SEQ ID NO: 652
  Description of Artificial Sequence: Synthetic Construct

SEQ ID NO: 677 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacacccacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 678 - protein, 416 aa, Artificial Sequence; identical to SEQ ID NO: 652
  Description of Artificial Sequence: Synthetic Construct

SEQ ID NO: 679 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgggccttccgacttagctcgcaaaaaacgcaagttcgataagaactaa

SEQ ID NO: 680 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIGPSDLARKKRKFDKN

SEQ ID NO: 681 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagcctcccgacttagctcgcaaaaaacgcaagttcgataagaactaa

SEQ ID NO: 682 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPPDLARKKRKFDKN

SEQ ID NO: 683 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaactgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 684 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVTAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 685 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaagtttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgaaccttccgacttagctcgcaaaaaacgcaagttcgataagaactaa

SEQ ID NO: 686 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIESLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 687 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgctctctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 688 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCSLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 689 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtggtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 690 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 691 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 692 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 693 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctacgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 694 - protein, 416 aa, Artificial Sequence; identical to SEQ ID NO: 692
  Description of Artificial Sequence: Synthetic Construct

SEQ ID NO: 695 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactacatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 696 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 697 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 698 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 699 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcagaaaacgcaagtccgataagaactaa

SEQ ID NO: 700 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARRKRKSDKN

SEQ ID NO: 701 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 702 - protein, 416 aa, Artificial Sequence; identical to SEQ ID NO: 696
  Description of Artificial Sequence: Synthetic Construct

SEQ ID NO: 703 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 704 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 705 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 706 - protein, 416 aa, Artificial Sequence; identical to SEQ ID NO: 692
  Description of Artificial Sequence: Synthetic Construct

SEQ ID NO: 707 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 708 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 709 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 710 - protein, 416 aa, Artificial Sequence; identical to SEQ ID NO: 692
  Description of Artificial Sequence: Synthetic Construct

SEQ ID NO: 711 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgactgtccgcgatgttttgctatcgggaggcgatgccctccttgtcagcgacgaacgcttggaatacatattgaagcgtctgcgcgaaatacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 712 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 713 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggagtacatattgaagcgtctgcgcgaaatacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 714 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 715 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 716 - protein, 416 aa, Artificial Sequence; identical to SEQ ID NO: 698
  Description of Artificial Sequence: Synthetic Construct

SEQ ID NO: 717 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 718 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 719 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagacgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 720 - protein, 416 aa, Artificial Sequence
  Description of Artificial Sequence: Synthetic Construct
MAESRRKYYFPDVTDEQWYDWHWQVINRIKTLAQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 721 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 722 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQMAIEPSDLARKKRKFDKN

SEQ ID NO: 723 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 724 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 725 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 726 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 727 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgctgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 728 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 729 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccccgatgtcaccgatgagcaatggtacgactggcattggcaggtcatcaaccgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaagaaacgcaagttcgataagaactaa

SEQ ID NO: 730 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 731 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgcccagctggaaaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 732 - protein, 416 aa, Artificial Sequence; identical to SEQ ID NO: 166
  Description of Artificial Sequence: Synthetic Construct

SEQ ID NO: 733 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 734 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 735 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctgccccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 736 - protein, 416 aa, Artificial Sequence
  Description of Artificial Sequence: Synthetic Construct
MAESRRKYYFPDVTDEQWYDWHWQVINRIKTLPQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 737 - DNA, 1251 bp, Artificial Sequence
  Description of Artificial Sequence: Synthetic mutant of Pgaam2 with AAM activity
  CDS (1)..(1251)
atggcagaaagtcgtagaaaggtatatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcgtcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 738 - protein, 416 aa, Artificial Sequence
  Description of Artificial Sequence: Synthetic Construct
MAESRRKVYFPDVTDEQWYDWHWQVINRIKTLDQLKKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRYAGQKDASSPSERVDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQMAIEPSDLARKKRKFDKN

SEQ ID NO: 739 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtccgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 740 - protein, 416 aa, Artificial Sequence
  Description of Artificial Sequence: Synthetic Construct
MAESRRKYYFPDVTDEQWYDWHWQVINRIKTLDQLKKSVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQLAIEPSDLARKKRKFDKN

SEQ ID NO: 741 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 742 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 743 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctgccccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 744 - protein, 416 aa, Artificial Sequence
  Description of Artificial Sequence: Synthetic Construct
MAESRRKYYFPDVTDEQWYDWHWQVINRIKTLPQLKKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQMAIEPSDLARKKRKFDKN

SEQ ID NO: 745 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 746 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQMAIEPSDLARKKRKFDKN

SEQ ID NO: 747 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 748 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 749 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 750 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQMAIEPSDLARKKRKFDKN

SEQ ID NO: 751 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 752 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 753 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 754 - protein, 416 aa, Artificial Sequence; identical to SEQ ID NO: 166
  Description of Artificial Sequence: Synthetic Construct

SEQ ID NO: 755 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccgcgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 756 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 757 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 758 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 759 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 760 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQLAIEPSDLARKKRKFDKN

SEQ ID NO: 761 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctacgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 762 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQLAIEPSDLARKKRKFDKN

SEQ ID NO: 763 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 764 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQMAIEPSDLARKKRKFDKN

SEQ ID NO: 765 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 766 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 767 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 768 - protein, 416 aa, Artificial Sequence; identical to SEQ ID NO: 758
  Description of Artificial Sequence: Synthetic Construct

SEQ ID NO: 769 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 770 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 771 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 772 - protein, 416 aa, Artificial Sequence; identical to SEQ ID NO: 154
  Description of Artificial Sequence: Synthetic Construct

SEQ ID NO: 773 - DNA, 1251 bp, Artificial Sequence
  Description of Artificial Sequence: Synthetic mutant of Pgaam2 with AAM activity
  CDS (1)..(1251)
atggcagaaagtcgtagaaagtatcatttccctgatgtcaccgatgagcaatggtacgactggcattggcaggtcaccaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 774 - protein, 416 aa, Artificial Sequence
  Description of Artificial Sequence: Synthetic Construct
MAESRRKYHFPDVTDEQWYDWHWQVTNRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 775 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 776 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 777 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcactacaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcatgaagagggtgtagctgcactttccggaggtcagcagatggctatcgagccttccgacttagctcgcaaaaaacgcaagttcgataagaactaa

SEQ ID NO: 778 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHYNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVILRNYEGVITTYTEPENYHEECDCEDCRAGKHEEGVAALSGGQQMAIEPSDLARKKRKFDKN

SEQ ID NO: 779 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 780 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQMAIEPSDLARKKRKFDKN

SEQ ID NO: 781 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgacgagcaatggtacgactggcattggcaggtcatcaaccgaattaagacgctgccccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 782 - protein, 416 aa, Artificial Sequence
  Description of Artificial Sequence: Synthetic Construct
MAESRRKYYFPDVTDEQWYDWHWQVINRIKTLPQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 783 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtgctccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 784 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 785 - DNA, 1251 bp, Artificial Sequence
  Description of Artificial Sequence: Synthetic mutant of Pgaam2 with AAM activity
  CDS (1)..(1251)
atggcagaaagtcgtagaaaggtatatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 786 - protein, 416 aa, Artificial Sequence
  Description of Artificial Sequence: Synthetic Construct
MAESRRKVYFPDVTDEQWYDWHWQVINRIKTLDQLKKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 787 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 788 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQMAIEPSDLARKKRKFDKN

SEQ ID NO: 789 - DNA, 1251 bp, Artificial Sequence
  Description of Artificial Sequence: Synthetic mutant of Pgaam2 with AAM activity
  CDS (1)..(1251)
atggcagaaagtcgtagaaaggtatatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaagcaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 790 - protein, 416 aa, Artificial Sequence
  Description of Artificial Sequence: Synthetic Construct
MAESRRKVYFPDVTDEQWYDWHWQVINRIKTLDQLKKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQMAIEPSDLARKKRKFDKN

SEQ ID NO: 791 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 792 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 793 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctgccccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 794 - protein, 416 aa, Artificial Sequence
  Description of Artificial Sequence: Synthetic Construct
MAESRRKYYFPDVTDEQWYDWHWQVINRIKTLPQLKKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 795 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 796 - protein, 416 aa, Artificial Sequence; identical to SEQ ID NO: 708
  Description of Artificial Sequence: Synthetic Construct

SEQ ID NO: 797 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 798 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 799 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 800 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 801 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgcattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 802 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRALFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 803 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgcccttcttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 804 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 805 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgtatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtaccccgactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 806 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPRLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 807 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 808 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQMAIEPSDLARKKRKFDKN

SEQ ID NO: 809 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 810 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 811 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 812 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQMAIEPSDLARKKRKFDKN

SEQ ID NO: 813 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctgccccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 814 - protein, 416 aa, Artificial Sequence
  Description of Artificial Sequence: Synthetic Construct
MAESRRKYYFPDVTDEQWYDWHWQVINRIKTLPQLKKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 815 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 816 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 817 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgacgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcccacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 818 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQMAIEPSDLARKKRKFDKN

SEQ ID NO: 819 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcggtcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 820 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIGRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 821 - DNA, 1251 bp, Artificial Sequence
  Description of Artificial Sequence: Synthetic mutant of Pgaam2 with AAM activity
  CDS (1)..(1251)
atggcagaaagtcgtagaaaggtatatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 822 - protein, 416 aa, Artificial Sequence
  Description of Artificial Sequence: Synthetic Construct
MAESRRKVYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 823 - DNA, 1251 bp, Artificial Sequence
  Description of Artificial Sequence: Synthetic mutant of Pgaam2 with AAM activity
  CDS (1)..(1251)
atggcagaaagtcgtagaaaggtatatttccctgatgtcaccgatgagcaatggtacgactggcattggcaggtcatcaaccgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 824 - protein, 416 aa, Artificial Sequence
  Description of Artificial Sequence: Synthetic Construct
MAESRRKVYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 825 - DNA, 1251 bp, Artificial Sequence
  Description of Artificial Sequence: Synthetic mutant of Pgaam2 with AAM activity
  CDS (1)..(1251)
atggcagaaagtcgtagaaaggtatatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 826 - protein, 416 aa, Artificial Sequence
  Description of Artificial Sequence: Synthetic Construct
MAESRRKVYFPDVTDEQWYDWHWQVINRIKTLDQLKKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 827 - DNA, 1251 bp, Artificial Sequence
  Description of Artificial Sequence: Synthetic mutant of Pgaam2 with AAM activity
  CDS (1)..(1251)
atggcagaaagtcgtagaaaggtatatttccctgatgtcaccgatgagcaatggtacgactggcattggcaggtcatcaatcgaattaagacgctgccccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 828 - protein, 416 aa, Artificial Sequence
  Description of Artificial Sequence: Synthetic Construct
MAESRRKVYFPDVTDEQWYDWHWQVINRIKTLPQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 829 - DNA, 1251 bp, Artificial Sequence
  Description of Artificial Sequence: Synthetic mutant of Pgaam2 with AAM activity
  CDS (1)..(1251)
atggcagaaagtcgtagaaaggtatatttccctgatgtcaccgatgagcaatggtacgactggcattggcaggtcatcaatcgaattaagacgctcgaccagctgaaaaagtacgttacgctcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 830 - protein, 416 aa, Artificial Sequence
  Description of Artificial Sequence: Synthetic Construct
MAESRRKVYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 831 - DNA, 1251 bp, Artificial Sequence
  Description of Artificial Sequence: Synthetic mutant of Pgaam2 with AAM activity
  CDS (1)..(1251)
atggcagaaagtcgtagaaaggtatatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctacgaaacaggaactggtacgtgctcctgaagatatggtagacccactcagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 832 - protein, 416 aa, Artificial Sequence
  Description of Artificial Sequence: Synthetic Construct
MAESRRKVYFPDVTDEQWYDWHWQVINRIKTLDQLKKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMAIEPSDLARKKRKFDKN

SEQ ID NO: 833 - DNA, 1251 bp, Artificial Sequence
  Description of Artificial Sequence: Synthetic mutant of Pgaam2 with AAM activity
  CDS (1)..(1251)
atggcagaaagtcgtagaaaggtatatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 834 - protein, 416 aa, Artificial Sequence
  Description of Artificial Sequence: Synthetic Construct
MAESRRKVYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 835 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 836 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQLAIEPSDLARKKRKFDKN

SEQ ID NO: 837 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgtcgtatctcagtccccacgacatgtgattcttcgcaattatgaaggtgttatcacaacctatacggagccggagacttatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 838 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVILRNYEGVITTYTEPETYHEECDCEDCRAGKHKEGVAALSGGQQLAIEPSDLARKKRKFDKN

SEQ ID NO: 839 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 840 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQMAIEPSDLARKKRKFDKN

SEQ ID NO: 841 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgtacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccctccgacttagctcgcaaaaaacgcaagttcgataagaactaa

SEQ ID NO: 842 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDVRLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 843 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 844 - protein, 416 aa, Artificial Sequence; identical to SEQ ID NO: 244
  Description of Artificial Sequence: Synthetic Construct

SEQ ID NO: 845 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggcacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtactcatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 846 - protein, 416 aa, Artificial Sequence
  Description of Artificial Sequence: Synthetic Construct
MAESRRKYYFPDVTDEQWHDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQMAIEPSDLARKKRKFDKN

SEQ ID NO: 847 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 848 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQMAIEPSDLARKKRKFDKN

SEQ ID NO: 849 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgcacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 850 - protein, 416 aa, Artificial Sequence; identical to SEQ ID NO: 186
  Description of Artificial Sequence: Synthetic Construct

SEQ ID NO: 851 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagtgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataatgagggtgtagctgcactttccggaggtcagcagttggctatcgagccttccgacttagctcgcaaaaaacgcaagttcgataagaactaa

SEQ ID NO: 852 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQCITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHNEGVAALSGGQQLAIEPSDLARKKRKFDKN

SEQ ID NO: 853 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatgtatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 854 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYMYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 855 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtgcacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 856 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCAHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 857 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcggaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 858 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIGIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 859 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctacgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 860 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQMAIEPSDLARKKRKFDKN

SEQ ID NO: 861 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctgccccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 862 - protein, 416 aa, Artificial Sequence
  Description of Artificial Sequence: Synthetic Construct
MAESRRKYYFPDVTDEQWYDWHWQVINRIKTLPQLKKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQMAIEPSDLARKKRKFDKN

SEQ ID NO: 863 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 864 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 865 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggaggattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 866 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVILRNYEGVITTYTEPEDYHEECDCEDCRAGKHKEGVAALSGGQQMAIEPSDLARKKRKFDKN

SEQ ID NO: 867 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 868 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQMAIEPSDLARKKRKFDKN

SEQ ID NO: 869 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactagtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtgggggtaaggtacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 870 - protein, 416 aa, Artificial Sequence
  Description of Artificial Sequence: Synthetic Construct
MAESRRKYYFPDVTDEQWYDWHWQVINRIKTLAQLKKYVTLTAEEEEGVKESPKVLRMAITPYYLSLIDPENPNCPIRKQAIPTKQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVAALSGGQQLAIEPSDLARKKRKFDKN

SEQ ID NO: 871 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgcccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaataggtcatttccgcacgccggtatctaaaggaatcgaaattatcgaaaatttgcgcggacacacctcgggctatgcagttcctacctttgtggtacatgctccggggggtggtggtaaggtacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagatggctatcgagccttccgacttagctcgcaaaaaacgcaagttcgataagaactaa

SEQ ID NO: 872 - protein, 416 aa, Artificial Sequence
  Description of Artificial Sequence: Synthetic Construct
MAESRRKYYFPDVTDEQWYDWHWQVINRIKTLAQLKKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVILRNYEGVITTYTEPENYHEECDCEDCRAGKHKEGVAALSGGQQMAIEPSDLARKKRKFDKN

SEQ ID NO: 873 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcacttcccggaggtcagcagttggctatcgagccttccgacttagctcgcaaaaaacgcaagttcgataagaactaa

SEQ ID NO: 874 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALPGGQQLAIEPSDLARKKRKFDKN

SEQ ID NO: 875 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 876 - protein, 416 aa, Artificial Sequence
  Description of Artificial Sequence: Synthetic Construct
MAESRRKYYFPDVTDEQWYDWHWQVINRIKTLDQLEKYVALTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 877 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 878 - protein, 416 aa, Artificial Sequence; identical to SEQ ID NO: 652
  Description of Artificial Sequence: Synthetic Construct

SEQ ID NO: 879 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttggctatcgagccttccgacttagctcgcaaaaaacgcaagttcgataagaactaa

SEQ ID NO: 880 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAAISGGQQLAIEPSDLARKKRKFDKN

SEQ ID NO: 881 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcaatctccggaggtcagcagttggctatcgagccttccgacttagctcgcaaaaaacgcaagttcgataagaactaa

SEQ ID NO: 882 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAAISGGQQLAIEPSDLARKKRKFDKN

SEQ ID NO: 883 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttggctatcgagccttccgacttagctcgcaaaaaacgcaagttcgataagaactaa

SEQ ID NO: 884 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVAPNYVVSQSPRHVVLRNYEGVITTYTEPENYHEECDCEDCRAGKHKEGVAAISGGQQLAIEPSDLARKKRKFDKN

SEQ ID NO: 885 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatttagttcttcgcaattatgaaggtgttatcacaacctatacggagccggagaattatcatgaggagtgcgattgtgaggactgtcgagccggtaagcataaagagggtgtagctgcaatctccggaggtcagcagttggctatcgagccttccgacttagctcgcaaaaaacgcaagagcgataagaactaa

SEQ ID NO: 886 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHLVLRNYEGVITTYTEPENYHEECDCEDCRAGKHKEGVAAISGGQQLAIEPSDLARKKRKSDKN

SEQ ID NO: 887 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactacatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtccctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 888 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVTPNYVVSQSPRHVVLRNYEGVITTYTEPEDYHEECDCEDCRAGKHKEGVAALSGGQQLAIEPSDLARKKRKFDKN

SEQ ID NO: 889 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 890 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVAPNYVVSQSPRHVVLRNYEGVITTYTEPENYHEECDCEDCRAGKHKEGVAALSGGQQLAIEPSDLARKKRKFDKN

SEQ ID NO: 891 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 892 - protein, 416 aa, Artificial Sequence; identical to SEQ ID NO: 206
  Description of Artificial Sequence: Synthetic Construct

SEQ ID NO: 893 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 894 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 895 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 896 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVAPNYVVSQSPRHVVLRNYEGVITTYTEPENYHEECDCEDCRAGKHKEGVAALSGGQQLAIEPSDLARKKRKFDKN

SEQ ID NO: 897 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 898 - protein, 416 aa, Artificial Sequence; identical to SEQ ID NO: 154
  Description of Artificial Sequence: Synthetic Construct

SEQ ID NO: 899 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 900 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLAIEPSDLARKKRKFDKN

SEQ ID NO: 901 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagagcgataagaactaa

SEQ ID NO: 902 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKSDKN

SEQ ID NO: 903 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 904 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 905 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttggctatcgagccttccgacttagctcgcaaaaaacgcaagttcgataagaactaa

SEQ ID NO: 906 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAAISGGQQLAIEPSDLARKKRKFDKN

SEQ ID NO: 907 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 908 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKVPVAPNYVVSQSPRHVVLRNYEGVITTYTEPENYHEECDCEDCRAGKHKEGVAALSGGQQLALEPSDLARKKRKFDKN

SEQ ID NO: 909 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 910 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKFDKN

SEQ ID NO: 911 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 912 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHKEGVAALSGGQQLAIEPSDLARKKRKFDKN

SEQ ID NO: 913 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagaccgataagaactaa

SEQ ID NO: 914 - protein, 416 aa, Artificial Sequence
  Description of Artificial Sequence: Synthetic Construct
MAESRRKYYFPDVTDEQWYDWHWQVINRIKTLAQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKTDKN

SEQ ID NO: 915 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtaggtgctccggggggtggtggtaaggtccctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 916 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVGAPGGGGKVPVTPNYVVSQSPRHVVLRNYEGVITTYTEPEDYHEECDCEDCRAGKHKEGVAALSGGQQLAIEPSDLARKKRKFDKN

SEQ ID NO: 917 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtaggtgctccggggggtggtggtaaggtccctttgacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 918 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKVPLTPNYVVSQSPRHVVLRNYEGVITTYTEPENYHEECDCEDCRAGKHKEGVAALSGGQQLAIEPSDLARKKRKFDKN

SEQ ID NO: 919 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagctcgataagaactaa

SEQ ID NO: 920 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKLDKN

SEQ ID NO: 921 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcggattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccgcgacatgtggttcttcgcaattatgaaggtgttaccacaacctatacggagccggaggactatcatgaggagtgcgattgtgaggactgtcgagccggtaagcataaagagggtgtagctgcaatctccggaggtcagcagttggctttagagccttccgacttagctcgcaaaaaacgcaagttcgataagaactaa

SEQ ID NO: 922 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVAPNYVVSQSPRHVVLRNYEGVTTTYTEPEDYHEECDCEDCRAGKHKEGVAAISGGQQLALEPSDLARKKRKFDKN

SEQ ID NO: 923 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgcctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatttagttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 924 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHLVLRNYEGVITTYTEPEDYHEECDCEDCRAGKHKEGVAALSGGQQLAIEPSDLARKKRKFDKN

SEQ ID NO: 925 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatttagttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 926 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHLVLRNYEGVITTYTEPEDYHEECDCEDCRAGKHKEGVAALSGGQQLAIEPSDLARKKRKFDKN

SEQ ID NO: 927 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcaacaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtgcgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 928 - protein, 416 aa, Artificial Sequence
  Description of Artificial Sequence: Synthetic Construct
MAESRRKYYFPDVTDEQWYDWHWQVNNRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYVCDLSLGIRHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLAIEPSDLARKKRKFDKN

SEQ ID NO: 929 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatcctcaaaaaatatcatccggtgtggctgaacactcacttcaaccacccgaatgaagttaccgaagaagcagtggaggcttgtgaaagaatggccaatgccggtattccgttgggtaaccaaacggtattattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttgacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 930 - protein, 416 aa, Artificial Sequence
  Description of Artificial Sequence: Synthetic Construct
MAESRRKYYFPDVTDEQWYDWHWQVINRIKTLAQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDILKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLTPNYVVSQSPRHVVLRNYEGVITTYTEPEDYHEECDCEDCRAGKHKEGVAALSGGQQLALEPSDLARKKRKSDKN

SEQ ID NO: 931 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 932 - protein, 416 aa, Artificial Sequence
  Description of Artificial Sequence: Synthetic Construct
MAESRRKYYFPDVTDEQWYDWHWQVINRIKTLAQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 933 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgaccgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtccctgtgacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcaatctccggaggtcagcagttggctatcgagccttccgacttagctcgcaaaaaacgcaagttcgataagaactaa

SEQ ID NO: 934 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIRHFRTPVSKGIEIIENLRGHTSGYAVPTFVVHAPGGGGKVPVTPNYVVSQSPRHVVLRNYEGVITTYTEPEDYHEECDCEDCRAGKHKEGVAAISGGQQLAIEPSDLARKKRKFDKN

SEQ ID NO: 935 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagggcgataagaactaa

SEQ ID NO: 936 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKGDKN

SEQ ID NO: 937 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagagcgataagaactaa

SEQ ID NO: 938 - protein, 416 aa, Artificial Sequence
  Description of Artificial Sequence: Synthetic Construct
MAESRRKYYFPDVTDEQWYDWHWQVINRIKTLAQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPEDYHEECDCEDCRAGKHKEGVAALSGGQQLAIEPSDLARKKRKSDKN

SEQ ID NO: 939 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 940 - protein, 416 aa, Artificial Sequence; identical to SEQ ID NO: 896
  Description of Artificial Sequence: Synthetic Construct

SEQ ID NO: 941 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcacgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtgacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcaatctccggaggtcagcagttggctatcgagccttccgacttagctcgcaaaaaacgcaagttcgataagaactaa

SEQ ID NO: 942 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVTPNYVVSQSPRHVVLRNYEGVITTYTEPEDYHEECDCEDCRAGKHKEGVAAISGGQQLAIEPSDLARKKRKFDKN

SEQ ID NO: 943 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtaggtgctccggggggtggtggtaaggtccctttggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 944 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVGAPGGGGKVPLAPNYVVSQSPRHVVLRNYEGVITTYTEPENYHEECDCEDCRAGKHKEGVAALSGGQQLALEPSDLARKKRKFDKN

SEQ ID NO: 945 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 946 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 947 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatcctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagagcgataagaactaa

SEQ ID NO: 948 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQRELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDILKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLAIEPSDLARKKRKSDKN

SEQ ID NO: 949 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagtccctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcaatctccggaggtcagcagttggctttagagccttccgacttagctcgcaaaaaacgcaagagcgataagaactaa

SEQ ID NO: 950 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVAPNYVVSQSPRHVVLRNYEGVITTYTEPEDYHEECDCEDCRAGKHKEGVAAISGGQQLALEPSDLARKKRKSDKN

SEQ ID NO: 951 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctcctcctgagcgcatcgatcgatgcattgactatatagccaatacaccgacagtccgcgatgttttgctatcgggaggcgatgccctccttgtcggcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtaggtgctccggggggtggtggtaagatccctgtgacgccgaactatgttgtatctcagtccccacgacatttagttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 952 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPPERIDRCIDYIANTPTVRDVLLSGGDALLVGDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVGAPGGGGKIPVTPNYVVSQSPRHLVLRNYEGVITTYTEPEDYHEECDCEDCRAGKHKEGVAALSGGQQLALEPSDLARKKRKFDKN

SEQ ID NO: 953 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatttagttcttcgcaattatgagggtgttatcacaacctatacggagccggaggactatcatgaggagtgcgattgtgaggactgtcgagccggtaagcataaagagggtgtagctgcaatctccggaggtcagcagttggctttagagccttccgacttagctcgcaaaaaacgcaagttcgataagaactaa

SEQ ID NO: 954 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKVPVAPNYVVSQSPRHLVLRNYEGVITTYTEPEDYHEECDCEDCRAGKHKEGVAAISGGQQLALEPSDLARKKRKFDKN

SEQ ID NO: 955 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagagcgataagaactaa

SEQ ID NO: 956 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKSDKN

SEQ ID NO: 957 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatcctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 958 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDILKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLAIEPSDLARKKRKFDKN

SEQ ID NO: 959 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcaatctccggaggtcagcagttggctatcgagccttccgacttagctcgcaaaaaacgcaagttcgataagaactaa

SEQ ID NO: 960 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAAISGGQQLAIEPSDLARKKRKFDKN

SEQ ID NO: 961 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcaatctccggaggtcagcagttggctttagagccttccgacttagctcgcaaaaaacgcaagagcgataagaactaa

SEQ ID NO: 962 - protein, 416 aa, Artificial Sequence
  Description of Artificial Sequence: Synthetic Construct
MAESRRKYYFPDVTDEQWYDWHWQVINRIKTLAQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAAISGGQQLALEPSDLARKKRKSDKN

SEQ ID NO: 963 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatcctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatccctgtggcgccgaactatgttgtatctcagtccccacgacatttagttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 964 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDILKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVAPNYVVSQSPRHLVLRNYEGVITTYTEPENYHEECDCEDCRAGKHKEGVAALSGGQQLALEPSDLARKKRKFDKN

SEQ ID NO: 965 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtgggggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagagcgataagaactaa

SEQ ID NO: 966 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVGACERMANAGIPLGNQTVLLRGINDCTHVMKRLVHLLVKMRVRPYYIYVCDLSLGIGHFRTPVSKGIEIIENLRGHTSGYAVPTFVVGAPGGGGKIPVTPNYVVSQSPRHVVLRNYEGVITTYTEPEDYHEECDCEDCRAGKHKEGVAALSGGQQLAIEPSDLARKKRKSDKN

SEQ ID NO: 967 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagctggctatcgagccttccgacttagctcgcaaaaaacgcaagttcgataagaactaa

SEQ ID NO: 968 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLAIEPSDLARKKRKFDKN

SEQ ID NO: 969 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagtccctacctttgtggtacatgctccggggggtggtggtaaggtccctgtggcgccgaactatgttgtatctcagtccccacgacatttagttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 970 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKVPVAPNYVVSQSPRHLVLRNYEGVITTYTEPEDYHEECDCEDCRAGKHKEGVAALSGGQQLALEPSDLARKKRKFDKN

SEQ ID NO: 971 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatttagttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 972 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHLVLRNYEGVITTYTEPENYHEECDCEDCRAGKHKEGVAALSGGQQLALEPSDLARKKRKFDKN

SEQ ID NO: 973 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatacgtcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 974 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIRHFRTPVSKGIEIIENLRGHTSGYAVPTFVVHAPGGGGKVPVAPNYVVSQSPRHVVLRNYEGVITTYTEPENYHEECDCEDCRAGKHKEGVAALSGGQQLALEPSDLARKKRKSDKN

SEQ ID NO: 975 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagagcctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgccgagccggtaagcataaagagggtgtagctgcactttccggaggtcagcagttggctatcgagccttccgacttagctcgcaaaaaacgcaagttcgataagaactaa

SEQ ID NO: 976 - protein, 416 aa, Artificial Sequence
  Description of Artificial Sequence: Synthetic Construct
MAESRRKYYFPDVTDEQWYDWHWQVINRIKSLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 977 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgagggctgccgtgccggtaagcataaagagggtgtagctgcactttccggaggtcagcagttggctatcgagccttccgacttagctcgcaagaaacgcaagttcgataagaactaa

SEQ ID NO: 978 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLMDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEGCRAGKHKEGVAALSGGQQLAIEPSDLARKKRKFDKN

SEQ ID NO: 979 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgacgaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 980 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLMDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 981 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgccgtgccggtaagcataaagagggtgtagctgcactttccggaggtcagcagttggctatcgagccttccgacttagctcgcaaaaaacgcaagttcgatatgaactaa

SEQ ID NO: 982 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDMN

SEQ ID NO: 983 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacccttgtggtacatgctccggggggtggtggtaagatacctgtagcgccgaactatgttgtatctcagtccccacgacatgtggttcttcgcaattatgaaggtgttatcacaacctatacggagccggagaattatcatgaggagtgcgattgtgaggactgccgagccggtaagcataaagagggtgtagctgcactttccggaggtcagcagttggctatcgagccttccgacttagctcgcaaaaaacgcaagttcgataagaactaa

SEQ ID NO: 984 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTLVVHAPGGGGKIPVAPNYVVSQSPRHVVLRNYEGVITTYTEPENYHEECDCEDCRAGKHKEGVAALSGGQQLAIEPSDLARKKRKFDKN

SEQ ID NO: 985 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgccgagccggtaagcataaagagggtgtagctgcactttccggaggtcagcagttggctatcgagccttccgacttagctcgcaaaaaacgcaagttcgataagaactaa

SEQ ID NO: 986 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLMDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 987 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgccgagccggtaagcataaagagggtgtagctgcactttccggaggtcagcagttggctatcgagccttccgacttagctcgcaaaaaacgcaagttcgataagaactaa

SEQ ID NO: 988 - protein, 416 aa, Artificial Sequence; identical to SEQ ID NO: 652
  Description of Artificial Sequence: Synthetic Construct

SEQ ID NO: 989 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtagaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgagggctgccgagccggtaagcataaagagggtgtagctgcactttccggaggtcagcagttggctatcgagccttccgacttagctcgcaaaaaacgcaagttcgataagaactaa

SEQ ID NO: 990 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRRINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEGCRAGKHKEGVAALSGGQQLAIEPSDLARKKRKFDKN

SEQ ID NO: 991 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgagggctgccgtgccggtaagcataaagagggtgtagctgcactttccggaggtcagcagttggctatcgagccttccgacttagctcgcaaaaaacgcaagttcgataagaactaa

SEQ ID NO: 992 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEGCRAGKHKEGVAALSGGQQLAIEPSDLARKKRKFDKN

SEQ ID NO: 993 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 994 - protein, 416 aa, Artificial Sequence; identical to SEQ ID NO: 652
  Description of Artificial Sequence: Synthetic Construct

SEQ ID NO: 995 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 996 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLMDPENPNCPIRKQAIPTQQELVRAPEDMVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 997 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggaatgccgtgccggtaagcataaagagggtgtagctgcactttccggaggtcagcagttggctatcgagccttccgacttagctcgcaaaaaacgcaagttcgataagaactaa

SEQ ID NO: 998 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEECRAGKHKEGVAALSGGQQLAIEPSDLARKKRKFDKN

SEQ ID NO: 999 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcccactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcatctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1000 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLMDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1001 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgagggctgccgagccggtaagcataaagagggtgtagctgcactttccggaggtcagcagttggctatcgagccttccgacttagctcgcaaaaaacgcaagttcgataagaactaa

SEQ ID NO: 1002 - protein, 416 aa, Artificial Sequence; identical to SEQ ID NO: 978
  Description of Artificial Sequence: Synthetic Construct

SEQ ID NO: 1003 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagagcctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagttcgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcaggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1004 - protein, 416 aa, Artificial Sequence; identical to SEQ ID NO: 976
  Description of Artificial Sequence: Synthetic Construct

SEQ ID NO: 1005 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagagtggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggaatgccgtgccggtaagcataaagagggtgtagctgcactttccggaggtcagcagttggctatcgagccttccgacttagctcgcaaaaaacgcaagttcgataagaactaa

SEQ ID NO: 1006 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLMDPENPNCPIRKQAIPTQQELVRAPEDMVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERVANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEECRAGKHKEGVAALSGGQQLAIEPSDLARKKRKFDKN

SEQ ID NO: 1007 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1008 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1009 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgacctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggaatgccgtgccggtaagcataaagagggtgtagctgcactttccggaggtcagcagttggctatcgagccttccgacttagctcgcaaaaaacgcaagttcgataagaactaa

SEQ ID NO: 1010 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEECRAGKHKEGVAALSGGQQLAIEPSDLARKKRKFDKN

SEQ ID NO: 1011 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagagcctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1012 - protein, 416 aa, Artificial Sequence; identical to SEQ ID NO: 976
  Description of Artificial Sequence: Synthetic Construct

SEQ ID NO: 1013 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggaatgccgagccggtaagcataaagagggtgtagctgcactttccggaggtcagcagttggctatcgagccttccgacttagctcgcaaaaaacgcaagttcgataagaactaa

SEQ ID NO: 1014 - protein, 416 aa, Artificial Sequence; identical to SEQ ID NO: 998
  Description of Artificial Sequence: Synthetic Construct

SEQ ID NO: 1015 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1016 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1017 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1018 - protein, 416 aa, Artificial Sequence; identical to SEQ ID NO: 996
  Description of Artificial Sequence: Synthetic Construct

SEQ ID NO: 1019 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgccgagccggtaagcataaagagggtgtagctgcactttccggaggtcagcagttggctatcgagccttccgacttagctcgcaaaaaacgcaagttcgataagaactaa

SEQ ID NO: 1020 - protein, 416 aa, Artificial Sequence; identical to SEQ ID NO: 1000
  Description of Artificial Sequence: Synthetic Construct

SEQ ID NO: 1021 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgacgactgccgtgccggtaagcataaagagggtgtagctgcactttccggaggtcagcagttggctatcgagccttccgacttagctcgcaaaaaacgcaagttcgataagaactaa

SEQ ID NO: 1022 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLMDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCDDCRAGKHKEGVAALSGGQQLAIEPSDLARKKRKFDKN

SEQ ID NO: 1023 - DNA, 1251 bp, Artificial Sequence
  Description of Artificial Sequence: Synthetic mutant of Pgaam2 with AAM activity
  CDS (1)..(1251)
atggcagaaagtcgtagaaagtattattttcctgatgtcaccgaggagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgccgtgccggtaagcataaagagggtgtagctgcactttccggaggtcagcagttggctatcgagccttccgacttagctcgcaaaaaacgcaagttcgataagaactaa

SEQ ID NO: 1024 - protein, 416 aa, Artificial Sequence
  Description of Artificial Sequence: Synthetic Construct
MAESRRKYYFPDVTEEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1025 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgacgaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgccgagccggtaagcataaagagggtgtagctgcactttccggaggtcagcagttggctatcgagccttccgacttagctcgcaaaaaacgcaagttcgataagaactaa

SEQ ID NO: 1026 - protein, 416 aa, Artificial Sequence; identical to SEQ ID NO: 980
  Description of Artificial Sequence: Synthetic Construct

SEQ ID NO: 1027 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgatcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgagggctgccgagccggtaagcataaagagggtgtagctgcactttccggaggtcagcagttggctatcgagccttccgacttagctcgcaaaaaacgcaagttcgataagaactaa

SEQ ID NO: 1028 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSDRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEGCRAGKHKEGVAALSGGQQLAIEPSDLARKKRKFDKN

SEQ ID NO: 1029 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1030 - protein, 416 aa, Artificial Sequence; identical to SEQ ID NO: 652
  Description of Artificial Sequence: Synthetic Construct

SEQ ID NO: 1031 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgtacgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgctgttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgccgagccggtaagcataaagagggtgtagctgcactttccggaggtcagcagttggctatcgagccttccgacttagctcgcaaaaaacgcaagttcgataagaactaa

SEQ ID NO: 1032 - protein, 416 aa, Artificial Sequence; identical to SEQ ID NO: 1000
  Description of Artificial Sequence: Synthetic Construct

SEQ ID NO: 1033 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1034 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTRVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1035 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcagcagttggctatcgagccttccgacttagctcgcaaaaaacgcaagttcgataggaactaa

SEQ ID NO: 1036 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDRN

SEQ ID NO: 1037 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagtccctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcagcagttggctatcgagccttccgacttagctcgcaaaaaacgcaagttcgataagaactaa

SEQ ID NO: 1038 - protein, 416 aa, Artificial Sequence; identical to SEQ ID NO: 652
  Description of Artificial Sequence: Synthetic Construct

SEQ ID NO: 1039 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctacacaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1040 - protein, 416 aa, Artificial Sequence; identical to SEQ ID NO: 652
  Description of Artificial Sequence: Synthetic Construct

SEQ ID NO: 1041 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcatcagttggctatcgagccttccgacttagctcgcaaaaaacgcaagttcgataagaactaa

SEQ ID NO: 1042 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGHQLAIEPSDLARKKRKFDKN

SEQ ID NO: 1043 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1044 - protein, 416 aa, Artificial Sequence; identical to SEQ ID NO: 652
  Description of Artificial Sequence: Synthetic Construct

SEQ ID NO: 1045 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggaggtaagatacctgtaacgccgaactatgttgtatctcagtcccctcgacatgtggttcttcgcaattatgaaggtgttatcacaagctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1046 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITSYTEPENYHEECDCEDCRAGKHKEGVAALSGGQQLAIEPSDLARKKRKFDKN

SEQ ID NO: 1047 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcagcagttggctatcgagccttccgacttagctcgcaaaaaacgcaagttcgataagaactaa

SEQ ID NO: 1048 - protein, 416 aa, Artificial Sequence; identical to SEQ ID NO: 652
  Description of Artificial Sequence: Synthetic Construct

SEQ ID NO: 1049 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccctctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagagtgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggaggtaagatacctgtaacgccgaactatgttgtatctcagtccccacgacatgtggttcttcgcaattatgaaggtgttatcacaagctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1050 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVESVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITSYTEPENYHEECDCEDCRAGKHKEGVAALSGGQQLAIEPSDLARKKRKFDKN

SEQ ID NO: 1051 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaatcaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1052 - protein, 416 aa, Artificial Sequence; identical to SEQ ID NO: 652
  Description of Artificial Sequence: Synthetic Construct

SEQ ID NO: 1053 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgctcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaatcaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggactggaaattatcgaaaatttgcgcggacacacctcgggctatgcagttcctacctttgtggtacatgctccggggggtggaggtaagatacctgtaacgccgaactatgttgtatctcagtccccacgacatgtggttcttcgcaattatgaaggtgttatcacaagctatacggagccggagaattatcatgaggagtgcgattgtgaggactgtcgagccggtaagcataaagagggtgtggctgcactttccggaggtcagcagttggctatcgagccttccgacttagctcgcaaaaaacgcaagttcgataagaactaa

SEQ ID NO: 1054 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGLEIIENLRGHTSGYAVPTFVVHAPGGGGKIPVTPNYVVSQSPRHVVLRNYEGVITSYTEPENYHEECDCEDCRAGKHKEGVAALSGGQQLAIEPSDLARKKRKFDKN

SEQ ID NO: 1055 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggactggaaattatcgaaaatctgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcatcagttggctatcgagccttccgacttagctcgcaaaaaacgcaagttcgataagaactaa

SEQ ID NO: 1056 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGLEIIENLRGHTSGYAVPTFVVHAPGGGGKIPVTPNYVVSQSPRHVVLRNYEGVITTYTEPENYHEECDCEDCRAGKHKEGVAALSGGHQLAIEPSDLARKKRKFDKN

SEQ ID NO: 1057 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttctttaagcactaa

SEQ ID NO: 1058 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFFKH

SEQ ID NO: 1059 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1060 - protein, 416 aa, Artificial Sequence; identical to SEQ ID NO: 652
  Description of Artificial Sequence: Synthetic Construct

SEQ ID NO: 1061 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgctagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcggttcctacctttgtggtacatgctccggggggtggtggtaagatacctgtatcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1062 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLASDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVSPNYVVSQSPRHVVLRNYEGVITTYTEPENYHEECDCEDCRAGKHKEGVAALSGGQQLAIEPSDLARKKRKFDKN

SEQ ID NO: 1063 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggaggtaagatacctgtaacgccgaactatgttgtatctcagtccccacgacatgtggttcttcgcaattatgaaggtgttatcacaacctatacggagccggagaatacacatgaggagtgcgattgtgaggactgtcgagccggtaagcataaagagggtgtggctgcactttccggaggtcagcagttggctatcgagccttccgacttagctcgcaaaaaacgcaagttcgataagaactaa

SEQ ID NO: 1064 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENTHEECDCEDCRAGKHKEGVAALSGGQQLAIEPSDLARKKRKFDKN

SEQ ID NO: 1065 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1066 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYVCDLSLGIRHFRTPVSKGIEIIENLRGHTSGYAVPTFVVHAPGGGGKIPITPNYVVSQSPRHVVLRNYEGVITTYTEPENYHEECDCEDCRAGKHKEGVAALSGGQQLAIEPSDLARKKRKFDKN

SEQ ID NO: 1067 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggactggaaattatcgaaaatttgcgcggacacacctcgggctatgcagttcctacctttgtggtacatgctccggggggtggaggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcatcagttggctatcgagccttccgacttagctcgcaaaaaacgcaagttcgataagaactaa

SEQ ID NO: 1068 - protein, 416 aa, Artificial Sequence; identical to SEQ ID NO: 1056
  Description of Artificial Sequence: Synthetic Construct

SEQ ID NO: 1069 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaatcaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtcccctcgacatgtggttcttcgcaattatgaaggtgttatcacaacctatacggagccggagaattatcatgaggagtgcgattgtgaggactgtcgagccggtaagcataaagagggtgtggctgcactttccggaggtcatcagttggctatcgagccttccgacttagctcgcaaaaaacgcaagttcgataagaactaa

SEQ ID NO: 1070 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGHQLAIEPSDLARKKRKFDKN

SEQ ID NO: 1071 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggaggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcatcagttggctatcgagccttccgacttagctcgcaaaaaacgcaagttcgataagaactaa

SEQ ID NO: 1072 - protein, 416 aa, Artificial Sequence; identical to SEQ ID NO: 1070
  Description of Artificial Sequence: Synthetic Construct

SEQ ID NO: 1073 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggactggaaattatcgaaaatctgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1074 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGLEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1075 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggactggaaattatcgaaaatctgcgcggacacacctcgggctatgcagttcctacctttgtggtacatgctccggggggtggtggtaagatacctgtaacgccgaactatgttgtatctcagtcccctcgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 1076 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGLEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1077 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaatcaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1078 - protein, 416 aa, Artificial Sequence; identical to SEQ ID NO: 652
  Description of Artificial Sequence: Synthetic Construct

SEQ ID NO: 1079 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggaggtaagatacctgtaacgccgaactatgttgtatctcagtcccctcgacatgtggttcttcgcaattatgaaggtgttatcacaacctatacggagccggagaattatcatgaggagtgcgattgtgaggactgtcgagccggtaagcataaagagggtgtggctgcactttccggaggtcagcagttggctatcgagccttccgacttagctcgcaaaaaacgcaagttcgataagaactaa

SEQ ID NO: 1080 - protein, 416 aa, Artificial Sequence; identical to SEQ ID NO: 652
  Description of Artificial Sequence: Synthetic Construct

SEQ ID NO: 1081 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1082 - protein, 416 aa, Artificial Sequence; identical to SEQ ID NO: 652
  Description of Artificial Sequence: Synthetic Construct

SEQ ID NO: 1083 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacacccacttcaaccacccgaatgaagttaccgaagaagcagtggaggcttgtgaaagaatggccaatgccggtattccgttgggtaatcaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcgtaaagagggtgtagctgcactttccggaggtcagcagttggctatcgagccttccgacttagctcgcaaaaaacgcaagttcgataagaactaa

SEQ ID NO: 1084 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKRKEGVAALSGGQQLAIEPSDLARKKRKFDKN

SEQ ID NO: 1085 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1086 - protein, 416 aa, Artificial Sequence; identical to SEQ ID NO: 652
  Description of Artificial Sequence: Synthetic Construct

SEQ ID NO: 1087 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacggacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaatcaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaagctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1088 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDGRLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITSYTEPENYHEECDCEDCRAGKHKEGVAALSGGQQLAIEPSDLARKKRKFDKN

SEQ ID NO: 1089 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatacttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggaggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1090 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDTSSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1091 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaatcaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1092 - protein, 416 aa, Artificial Sequence; identical to SEQ ID NO: 652
  Description of Artificial Sequence: Synthetic Construct

SEQ ID NO: 1093 - DNA, 1251 bp, Porphyromonas gingivalis
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaaggatcgcccaaagtactccgaatggctatcacaccttattatttgagtttgatagaccccgagaatcctaattgtccgattcgtaaacaagccattcctacccaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcagcagttggctatcgagccctccgacttagctcgcaaaaaacgcaagttcgataggaactaa

SEQ ID NO: 1094 - protein, 416 aa, Porphyromonas gingivalis
MAESRRKYYFPDVTDEQWYDWHWQVINRIKTLDQLEKYVTLTAEEEEGVKGSPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDRN

SEQ ID NO: 1095 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggaggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcatcagttggctatcgagccttccgacttagctcgcaaaaaacgcaagttcgataagaactaa

SEQ ID NO: 1096 - protein, 416 aa, Artificial Sequence; identical to SEQ ID NO: 1070
  Description of Artificial Sequence: Synthetic Construct

SEQ ID NO: 1097 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcccgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatacttcttctccttctgagcgcatcgatcgatgcattgagtatatagccaatacaccgacagtccgcgatgttttgctatcgggaggcgatgccctccttgtcagcgacgaacgtttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggaggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgaaccttccgacttagctcgcaaaaaacgcaagttcgataagaactaa

SEQ ID NO: 1098 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDTSSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1099 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgtgcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggactggaaattatcgaaaatctgcgcggacacacctcgggctatgcagttcctacctttgtggtacatgctccggggggtggaggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataggaactaa

SEQ ID NO: 1100 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSVRIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGLEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDRN

SEQ ID NO: 1101 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1102 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1103 - DNA, 1251 bp, Porphyromonas gingivalis
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggtttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtcccctcgacatgtggttcttcgcaattatgaaggtgttatcacaacctatacggagccggagaattatcatgaggagtgcgattgtgaggactgtcgagccggtaagcataaagagggtgtggctgcactttccggaggtcagcagttggctatcgagccttccgacttagctcgcaaaaaacgcaagttcgataagaactaa

SEQ ID NO: 1104 - protein, 416 aa, Porphyromonas gingivalis
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEVCERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1105 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatacttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggaggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcagcagttggctatcgagccttccgacttagctcgcaaaaaacgcaagttcgataagaactaa

SEQ ID NO: 1106 - protein, 416 aa, Artificial Sequence; identical to SEQ ID NO: 1090
  Description of Artificial Sequence: Synthetic Construct

SEQ ID NO: 1107 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtcccctcgacatgtggttcttcgcaattatgaaggtgttatcacaacctatacggagccggagaattatcatgaggagtgcgattgtgaggactgtcgagccggtaagcataaagagggtgtagctgcactttccggaggtcatcagttggctatcgagccttccgacttagctcgcaaaaaacgcaagttcgataagaactaa

SEQ ID NO: 1108 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGHQLAIEPSDLARKKRKFDKN

SEQ ID NO: 1109 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcatcagttggctatcgagccttccgactcagctcgcaaaaaacgcaagttcgataagaactaa

SEQ ID NO: 1110 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGHQLAIEPSDSARKKRKFDKN

SEQ ID NO: 1111 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggaggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcagcagttggctatcgagccttccgacttagctcgcaaaaaacgcaagttcgataagaactaa

SEQ ID NO: 1112 - protein, 416 aa, Artificial Sequence; identical to SEQ ID NO: 652
  Description of Artificial Sequence: Synthetic Construct

SEQ ID NO: 1113 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatacttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaatcaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcagcagttggctatcgagccttccgacttagctcgcaaaaaacgcaagttcgataagaactaa

SEQ ID NO: 1114 - protein, 416 aa, Artificial Sequence; identical to SEQ ID NO: 1090
  Description of Artificial Sequence: Synthetic Construct

SEQ ID NO: 1115 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatctgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtggctgcactttccggaggtcagcagttggctatcgagccttccgacttagctcgcaaaaaacgcaagttcgataagaactaa

SEQ ID NO: 1116 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1117 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggagtcaatgattgtacacatgtgatgaagagattggtacatttgctggtaaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccggtaagcataaagagggtgtagctgcactttccggaggtcagcagttggctatcgagctgtccgacttagctcgcaaaaaacgcaagttcgataagaactaa

SEQ ID NO: 1118 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGVNDCTHVMKRLVHLLVKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIELSDLARKKRKFDKN

SEQ ID NO: 1119 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgaataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagtttgataagaactaa

SEQ ID NO: 1120 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1121 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggcgtagctgcactttccggaggtcagcagttggctatcgagccttccgacttagctcgcaaaaaacgcaagttcgataagaactaa

SEQ ID NO: 1122 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRADKHKEGVAALSGGQQLAIEPSDLARKKRKFDKN

SEQ ID NO: 1123 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgaaccttccgacttagctcgcaaaaaacgcaagttcgataagaactaa

SEQ ID NO: 1124 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRADKHKEGVAALSGGQQLAIEPSDLARKKRKFDKN

SEQ ID NO: 1125 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatattgaagcgtctgcgcgaagtacctcatgtggagattgttcgtatcggaagccgtacgccggtagtcatgcctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcaacagttggctatcgagccttccgacttagctcgcaaaaaacgcaagttcgataagaactaa

SEQ ID NO: 1126 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVMPQRITPQLVDMLKKYHPVWLNTHFNHPNEVTEEAVEACERMANAGIPLGNQTVLLRGINDCTHVMKRLVHLLVKIRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAAISGGQQLAIEPSDLARKKRKFDKN

SEQ ID NO: 1127 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgctcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggcaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1128 - protein, 416 aa, Artificial Sequence; identical to SEQ ID NO: 1120
  Description of Artificial Sequence: Synthetic Construct

SEQ ID NO: 1129 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggtgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgactgtacacatgtgatgaagagattggtacatttgctggtaaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagctgtccgacttagctcgcaaaaaacgcaagttcgataagaactaa

SEQ ID NO: 1130 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIELSDLARKKRKFDKN

SEQ ID NO: 1131 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1132 - protein, 416 aa, Artificial Sequence; identical to SEQ ID NO: 652
  Description of Artificial Sequence: Synthetic Construct

SEQ ID NO: 1133 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagttcgataagaactaa

SEQ ID NO: 1134 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRADKHKEGVAALSGGQQLAIEPSDLARKKRKFDKN

SEQ ID NO: 1135 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacttatcgttatccggatcgtgtattgttccttatcacggacaaatgttcgatgtactgtcgtcattgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcctggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1136 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTYRYPDRVLFLITDKCSMYCRHCTRRRFAGQKDASSPSVRIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1137 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacccttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1138 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTLVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1139 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1140 - protein, 416 aa, Artificial Sequence; identical to SEQ ID NO: 1120
  Description of Artificial Sequence: Synthetic Construct

SEQ ID NO: 1141 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1142 - protein, 416 aa, Artificial Sequence; identical to SEQ ID NO: 652
  Description of Artificial Sequence: Synthetic Construct

SEQ ID NO: 1143 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1144 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1145 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaggtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctacactttccggaggtcagcagttggctatcgaaccttccgacttagctcgcaaaaaacgcaagttcgataagaactaa

SEQ ID NO: 1146 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVATLSGGQQLAIEPSDLARKKRKFDKN

SEQ ID NO: 1147 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1148 - protein, 416 aa, Artificial Sequence; identical to SEQ ID NO: 1120
  Description of Artificial Sequence: Synthetic Construct

SEQ ID NO: 1149 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggtgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaacaacgcaagttcgataagaactaa

SEQ ID NO: 1150 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKQRKFDKN

SEQ ID NO: 1151 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggtgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggcggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1152 - protein, 416 aa, Artificial Sequence; identical to SEQ ID NO: 652
  Description of Artificial Sequence: Synthetic Construct

SEQ ID NO: 1153 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatccaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccggtaagcataaagagggtgtagctgcactttccggaggtcagcagttggctatcgagctgtccgacttagctcgcaaaaaacgcaagttcgataagaactaa

SEQ ID NO: 1154 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIELSDLARKKRKFDKN

SEQ ID NO: 1155 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacggtccgcgatgttttgctatcgggaggtgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1156 - protein, 416 aa, Artificial Sequence; identical to SEQ ID NO: 1144
  Description of Artificial Sequence: Synthetic Construct

SEQ ID NO: 1157 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtacgccggtagtcatgcctcagcgtataacgcctcaattggtggatatgctcaaaaaatatcatccggtgtggctgaacactcacttcaaccacccgaatgaagttaccgaagaagcagtggaggcttgtgaaagagtggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacccgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1158 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVMPQRITPQLVDMLKKYHPVWLNTHFNHPNEVTEEAVEACERVANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1159 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgtcacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1160 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1161 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1162 - protein, 416 aa, Artificial Sequence; identical to SEQ ID NO: 652
  Description of Artificial Sequence: Synthetic Construct

SEQ ID NO: 1163 - DNA, 1251 bp, Artificial Sequence
  Description of Artificial Sequence: Synthetic mutant of Pgaam2 with AAM activity
  CDS (1)..(1251)
atggcaaaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtccgtataggaagccgtacgccggtagtcctccctcagcgtataacgcctcaattggtggaaatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1164 - protein, 416 aa, Artificial Sequence
  Description of Artificial Sequence: Synthetic Construct
MAKSRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVEMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1165 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtgcctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1166 - protein, 416 aa, Artificial Sequence; identical to SEQ ID NO: 1120
  Description of Artificial Sequence: Synthetic Construct

SEQ ID NO: 1167 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgagtgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1168 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPSEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1169 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcctggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctacactttccggaggtcagcagttggctatcgagccttccgacttagctcgcaaaaaacgcaagttcgataagaactaa

SEQ ID NO: 1170 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVATLSGGQQLAIEPSDLARKKRKFDKN

SEQ ID NO: 1171 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1172 - protein, 416 aa, Artificial Sequence; identical to SEQ ID NO: 652
  Description of Artificial Sequence: Synthetic Construct

SEQ ID NO: 1173 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctcccccagcgaataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagttcgataagaactaa

SEQ ID NO: 1174 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRADKHKEGVAALSGGQQLAIEPSDLARKKRKFDKN

SEQ ID NO: 1175 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctcccccagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagctggctatcgagccttccgacttagctcgcaaaaaacgcaagttcgataagaactaa

SEQ ID NO: 1176 - protein, 416 aa, Artificial Sequence; identical to SEQ ID NO: 652
  Description of Artificial Sequence: Synthetic Construct

SEQ ID NO: 1177 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1178 - protein, 416 aa, Artificial Sequence; identical to SEQ ID NO: 1160
  Description of Artificial Sequence: Synthetic Construct

SEQ ID NO: 1179 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgaataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgagattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctacactttccggaggtcagcagttggctatcgagccttccgacttagctcgcaaaaaacgcaagttcgataagaactaa

SEQ ID NO: 1180 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVATLSGGQQLAIEPSDLARKKRKFDKN

SEQ ID NO: 1181 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgcggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacccgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagttcgataagaactaa

SEQ ID NO: 1182 - protein, 416 aa, Artificial Sequence; identical to SEQ ID NO: 1122
  Description of Artificial Sequence: Synthetic Construct

SEQ ID NO: 1183 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcctggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagttcgataagaactaa

SEQ ID NO: 1184 - protein, 416 aa, Artificial Sequence; identical to SEQ ID NO: 1122
  Description of Artificial Sequence: Synthetic Construct

SEQ ID NO: 1185 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggtgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagcctcccgacttagctcgcaaaaaacgcaagttcgataagaactaa

SEQ ID NO: 1186 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPPDLARKKRKFDKN

SEQ ID NO: 1187 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggtgatgccctccttgtcagcgacgaacgcctggaatacatattgaagcgtctgcgcgaagtacctcatgtggagattgttcgtataggaagccgtacgccggtagtcctccctcagcgaataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagctgtccgacttagctcgcaaaaaacgcaagtttgataagaactaa

SEQ ID NO: 1188 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIELSDLARKKRKFDKN

SEQ ID NO: 1189 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacggtccgcgatgttttgctatcgggaggtgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacacgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1190 - protein, 416 aa, Artificial Sequence; identical to SEQ ID NO: 1160
  Description of Artificial Sequence: Synthetic Construct

SEQ ID NO: 1191 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcctggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccggtaagcataaagagggtgtagctacactttccggaggtcagcagttggctatcgagccttccgacttagctcgcaaaaaacgcaagttcgataagaactaa

SEQ ID NO: 1192 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRAGKHKEGVATLSGGQQLAIEPSDLARKKRKFDKN

SEQ ID NO: 1193 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggtgatgccctccttgtcagcgacgaacgcttggaatacatattgaagcgtctgcgcgaagtacctcatgtggagattgttcgtataggaagccgtacgccggtagtcctccctcagcgtataacgcctcaattggtggaaatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgatgggaatacgtcatttccgtacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagctgtccgacttagctcgcaaaaaacgcaagttcgataagaactaa

SEQ ID NO: 1194 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVEMLKKYHPVWLNTHFNHPNEVTEEAVEACERMANAGIPLGNQTVLLRGINDCTHVMKRLVHLLVKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRADKHKEGVAALSGGQQLAIELSDLARKKRKFDKN

SEQ ID NO: 1195 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1196 - protein, 416 aa, Artificial Sequence; identical to SEQ ID NO: 1120
  Description of Artificial Sequence: Synthetic Construct

SEQ ID NO: 1197 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1198 - protein, 416 aa, Artificial Sequence; identical to SEQ ID NO: 652
  Description of Artificial Sequence: Synthetic Construct

SEQ ID NO: 1199 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccggtaagcataaagagggtgtagctacactttccggaggtcagcagttggctatcgaaccttccgacttagctcgcaaaaaacgcaagttcgataagaactaa

SEQ ID NO: 1200 - protein, 416 aa, Artificial Sequence; identical to SEQ ID NO: 1170
  Description of Artificial Sequence: Synthetic Construct

SEQ ID NO: 1201 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggtgatgccctccttgtcagcgacgaacgcttggaatacatattgaagcgtctgcgcgaagtacctcatgtggagattgttcgtataggaagccgtacgccggtagtcctccctcagcgaataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgcggaatcaatgattgtacacatgtgatgaagagattggtacatttgctggtgaagattcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1202 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1203 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccagtacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcatgcctcagcgaataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagttcgataagaactaa

SEQ ID NO: 1204 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVMPQRITPQLVDMLKKYHPVWLNTHFNHPNEVTEEAVEACERMANAGIPLGNQTVLLRGINDCTHVMKRLVHLLVKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRADKHKEGVAALSGGQQLAIEPSDLARKKRKFDKN

SEQ ID NO: 1205 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagttcgataagaactaa

SEQ ID NO: 1206 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRADKHKEGVAALSGGQQLAIEPSDLARKKRKFDKN

SEQ ID NO: 1207 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggtgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1208 - protein, 416 aa, Artificial Sequence; identical to SEQ ID NO: 1144
  Description of Artificial Sequence: Synthetic Construct

SEQ ID NO: 1209 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggtgatgccctccttgtcagcgacgaacgcttggaatacatattgaagcgtctgcgcgaagtacctcatgtggagattgttcgtataggaagccgtacgccggtagtcctccctcagcgtataacgcctcaattggtggaaatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1210 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVEMLKKYHPVWLNTHFNHPNEVTEEAVEACERMANAGIPLGNQTVLLRGINDCTHVMKRLVHLLVKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1211 - DNA, 1251 bp, Artificial Sequence
  Description of Artificial Sequence: Synthetic mutant of Pgaam2 with AAM activity
  CDS (1)..(1251)
atggcagagagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggtgatgccctccttgtcagcgacgaacgcttggaatacatattgaagcgtctgcgcgaagtacctcatgtggagattgttcgtatcggaagccgtacgccggtagtcatgcctcagcgaataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctgataaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1212 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVMPQRITPQLVDMLKKYHPVWLNTHFNHPNEVTEEAVEACERMANAGIPLGNQTVLLRGINDCTHVMKRLVHLLIKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1213 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatcaggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagagcgataagaactaa

SEQ ID NO: 1214 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLAIEPSDLARKKRKSDKN

SEQ ID NO: 1215 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1216 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 1217 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtggacccacttagtgaagatgaagattcgcccgtacccggactgactcatcgttatccggatcgtgtattgttccttatcacggacaaatgttcggtgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1218 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSVYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1219 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatggttgtacacatgtgatgaagagattggtacatttgctggtaaagatgcgtgtgcgtccttactatatatatgcttgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcaatctccggaggtcagcagttggctatcgagccttccgacttagctcgcaaaaaacgcaagttcgataagaactaa

SEQ ID NO: 1220 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINGCTHVMKRLVHLLVKMRVRPYYIYACDLSLGIRHFRTPVSKGIEIIENLRGHTSGYAVPTFVVHAPGGGGKIPVTPNYVVSQSPRHVVLRNYEGVITTYTEPEDYHEECDCEDCRAGKHKEGVAAISGGQQLAIEPSDLARKKRKFDKN

SEQ ID NO: 1221 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1222 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVGAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1223 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcagttatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1224 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIRHFRTPVSKGIEIIENLRGHTSGYAVPTFVVHAPGGGGKIPVTPNYVVSQSPRHVVLRSYEGVITTYTEPENYHEECDCEDCRAGKHKEGVAALSGGQQLAIEPSDLARKKRKFDKN

SEQ ID NO: 1225 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgtaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattgtgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1226 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFVGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNCEGVITTYTEPENYHEECDCEDCRAGKHKEGVAALSGGQQLAIEPSDLARKKRKFDKN

SEQ ID NO: 1227 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttggctatcgagccttccgacttagctcgcaaaaaacgcaagagcgataagaactaa

SEQ ID NO: 1228 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLRGVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAAISGGQQLAIEPSDLARKKRKSDKN

SEQ ID NO: 1229 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgtttcgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtaggtgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcaatctccggaggtcagcagttggctatcgagccttccgacttagctcgcaaaaaacgcaagttcgataagaactaa

SEQ ID NO: 1230 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVSLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVGAPGGGGKIPVTPNYVVSQSPRHVVLRNYEGVITTYTEPEDYHEECDCEDCRAGKHKEGVAAISGGQQLAIEPSDLARKKRKFDKN

SEQ ID NO: 1231 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggaaatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1232 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVEMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1233 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgcggaatcaatgattgtacacatgtgatgaagagattggtacatttgctggtgaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctgcactttccggaggtcagcagttggctatcgagctgtccgacttagctcgcaaaaaacgcaagttcgataagaactaa

SEQ ID NO: 1234 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRADKHKEGVAALSGGQQLAIELSDLARKKRKFDKN

SEQ ID NO: 1235 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatgatagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggtgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatgtgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagcgcggttgtgaggactgtcgagccgacaagcataaagagggtgtagctgcactttccggaggtcagcagttggctatcgagccttccgacttagctcgcaaaaaacgcaagttcgataagaactaa

SEQ ID NO: 1236 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMIDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDVLKKYHPVWLNTHFNHPNEVTEEAVEACERMANAGIPLGNQTVLLRGINDCTHVMKRLVHLLVKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEERGCEDCRADKHKEGVAALSGGQQLAIEPSDLARKKRKFDKN

SEQ ID NO: 1237 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcctggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccggtaagcataaagagggtgtagctgcactttccggaggtcagcagttggctatcgagctgtccgacttagctcgcaaaaaacgcaagttcgataagaactaa

SEQ ID NO: 1238 - protein, 416 aa, Artificial Sequence; identical to SEQ ID NO: 1130
  Description of Artificial Sequence: Synthetic Construct

SEQ ID NO: 1239 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgcggagattgttcgtataggaagccgtacgccggtagtcctccctcagcgtataacgcctcaattggtggatatgctcaaaaaatatcatccggtgtggctgaacactcacttcaaccacccgaacgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1240 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHAEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1241 - DNA, 1251 bp, Artificial Sequence
  Description of Artificial Sequence: Synthetic mutant of Pgaam2 with AAM activity
  CDS (1)..(1251)
atggcagaaagtcgtagaaggtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctcccccagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggagaattatcatgaggagtgcgattgtgaggactgtcgagccgacaagcataaagagggtgtagctgcactttccggaggtcagcagttggctatcgagccttccgacttagctcgcaaaaaacgcaagttcgataagaactaa

SEQ ID NO: 1242 - protein, 416 aa, Artificial Sequence
  Description of Artificial Sequence: Synthetic Construct
MAESRRRYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRADKHKEGVAALSGGQQLAIEPSDLARKKRKFDKN

SEQ ID NO: 1243 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatcggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgcggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1244 - protein, 416 aa, Artificial Sequence; identical to SEQ ID NO: 652
  Description of Artificial Sequence: Synthetic Construct

SEQ ID NO: 1245 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1246 - protein, 416 aa, Artificial Sequence; identical to SEQ ID NO: 652
  Description of Artificial Sequence: Synthetic Construct

SEQ ID NO: 1247 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcaatctccggaggtcagcagttggctatcgaactgtccgacttagctcgcaaaaaacgcaagttcgataagaactaa

SEQ ID NO: 1248 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAAISGGQQLAIELSDLARKKRKFDKN

SEQ ID NO: 1249 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacggtccgcgatgttttgctatcgggaggcgatgccctccttgtcagcgacgaacgcctggaatacatattgaagcgtctgcgcgaagtacctcatgtggagattgttcgtatcggaagccgtacgccggtagtcctccctcagcgtataacgcctcaattggtggaaatgctcaaaaaatatcatccggtgtggctgaacactcacttcaaccacccgaatgaagttaccgaagaagcagtggaggcttgtgaaagaatggccaatgccggtattccgttgggtaaccaaacggttttactgcgtggaatcaatgattgtacacatgtgatgaagagattggtacatttgctggtgaagatgcgtgtgcgtccttactatatatatgtatgcgatctttcgatgggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccgacaagcataaagagggtgtagctacactttccggaggtcagcagttggctatcgagccttccgacttagctcgcaaaaaacgcaagttcgataagaactaa

SEQ ID NO: 1250 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVEMLKKYHPVWLNTHFNHPNEVTEEAVEACERMANAGIPLGNQTVLLRGINDCTHVMKRLVHLLVKMRVRPYYIYVCDLSMGIRHFRTPVSKGIEIIENLRGHTSGYAVPTFVVHAPGGGGKIPVTPNYVVSQSPRHVVLRNYEGVITTYTEPENYHEECDCEDCRADKHKEGVATLSGGQQLAIEPSDLARKKRKFDKN

SEQ ID NO: 1251 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcagaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1252 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLRKYHPVWLNTHFNHPNEVTEEAVEACERMANAGIPLGNQTVLLRGINDCTHVMKRLVHLLVKMRVRPYYIYACDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1253 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgcccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1254 - protein, 416 aa, Artificial Sequence
  Description of Artificial Sequence: Synthetic Construct
MAESRRKYYFPDVTDEQWYDWHWQVINRIKTLAQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1255 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1256 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIRHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLAIEPSDLARKKRKFDKN

SEQ ID NO: 1257 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagtagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1258 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEVAVEACERMANAGIPLGNQTVLLRGINDCTHVMKRLVHLLVKMRVRPYYIYACDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1259 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctgaaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggggatgccctccttgtcagcaacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1260 - protein, 416 aa, Artificial Sequence
  Description of Artificial Sequence: Synthetic Construct
MAESRRKYYFPDVTDEQWYDWHWQVINRIKTLDQLKKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSNERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1261 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1262 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPENYHEECDCEDCRAGKHKEGVAALSGGQQLAIEPSDLARKKRKFDKN

SEQ ID NO: 1263 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccagtacaccgacggtccgcgatgttttgctatcgggaggcgatgccctccttgtcagcgacgaacgcttggaatacatattgaagcgtctgcgcgaagtacctcatgtggagattgttcgtatcggaagccgtacgccggtagtcctcccccagcgaataacgcctcaattggtggaaatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgtatgcgatctttcgcttggaatacgtcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctatcgagccttccgacttagctcgcaaaaaacgcaagttcgataagaactaa

SEQ ID NO: 1264 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIASTPTVRDVLLSGGDALLVSDERLEYILKRLREVPHVEIVRIGSRTPVVLPQRITPQLVEMLKKYHPVWLNTHFNHPNEVTEEAVEACERMANAGIPLGNQTVLLRGINDCTHVMKRLVHLLVKIRVRPYYIYVCDLSLGIRHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLAIEPSDLARKKRKFDKN

SEQ ID NO: 1265 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagatggctttagagccttccgacttagctcgcaaaaaacgcaagttcgataagaactaa

SEQ ID NO: 1266 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQMALEPSDLARKKRKFDKN

SEQ ID NO: 1267 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagatggctttagagccttccgacttagctcgcaaaaaacgcaagttcgataagaactaa

SEQ ID NO: 1268 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQMALEPSDLARKKRKFDKN

SEQ ID NO: 1269 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtaaccgcactttccggaggtcagcagttggctttagagccttccgacttagctcgcaaaaaacgcaagagcgataagaactaa

SEQ ID NO: 1270 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPENYHEECDCEDCRAGKHREGVTALSGGQQLALEPSDLARKKRKSDKN

SEQ ID NO: 1271 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1272 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLALEPSDLARKKRKFDKN

SEQ ID NO: 1273 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1274 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1275 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1276 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1277 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1278 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVILRNYEGVITTYTEPEDYHEECDCEDCRAGKHKEGVAALSGGQQLALEPSDLARKKRKSDKN

SEQ ID NO: 1279 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1280 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 1281 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1282 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1283 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1284 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVTTTYTEPEDYHEECDCEDCRAGKHKEGVAALSGGQQLALEPSDLARKKRKFDKN

SEQ ID NO: 1285 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtaacgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1286 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVTPNYVVSQSPRHVVLRNYEGVITTYTEPEDYHEECDCEDCRAGKHREGVAALSGGQQLALEPSDLARKKRKFDKN

SEQ ID NO: 1287 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1288 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPENYHEECDCEDCRAGKHREGVAALSGGQQLALEPSDLARKKRKFDKN

SEQ ID NO: 1289 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgtaccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccctactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1290 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLYLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1291 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1292 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLALEPSDLARKKRKSDKN

SEQ ID NO: 1293 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1294 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPENYHEECDCEDCRAGKHREGVAALSGGQQLALEPSDLARKKRKFDKN

SEQ ID NO: 1295 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1296 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1297 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccgttcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtgacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtaaccgcactttccggaggtcagcagttggctttagagccttccgacttagctcgcaaaaaacgcaagttcgataagaactaa

SEQ ID NO: 1298 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAVPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVTPNYVVSQSPRHVVLRNYEGVITTYTEPENYHEECDCEDCRAGKHKEGVTALSGGQQLALEPSDLARKKRKFDKN

SEQ ID NO: 1299 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagggggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1300 - protein, 416 aa, Artificial Sequence
  Description of Artificial Sequence: Synthetic Construct
MAESRRKYYFPDVTDEQWYDWHWQVINRIKTLDQLEKYVTLTAEEEGGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1301 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgtagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtaaccgcactttccggaggtcagcagttggctttagagccttccgacttagctcgcaaaaaacgcaagttcgataagaactaa

SEQ ID NO: 1302 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTVEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHREGVTALSGGQQLALEPSDLARKKRKFDKN

SEQ ID NO: 1303 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1304 - protein, 416 aa, Artificial Sequence; identical to SEQ ID NO: 1272
  Description of Artificial Sequence: Synthetic Construct

SEQ ID NO: 1305 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtaaccgcactttccggaggtcagcagttggctttagagccttccgacttagctcgcaaaaaacgcaagttcgataagaactaa

SEQ ID NO: 1306 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVTALSGGQQLALEPSDLARKKRKFDKN

SEQ ID NO: 1307 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagatggctttagagccttccgacttagctcgcaaaaaacgcaagagcgataagaactaa

SEQ ID NO: 1308 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQMALEPSDLARKKRKSDKN

SEQ ID NO: 1309 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1310 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVILRNYEGVITTYTEPEDYHEECDCEDCRAGKHREGVAALSGGQQLALEPSDLARKKRKFDKN

SEQ ID NO: 1311 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctagaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagatggctttagagccttccgacttagctcgcaaaaaacgcaagttcgataagaactaa

SEQ ID NO: 1312 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSRGIEIIENLRGHTSGYAVPTFVVHAPGGGGKIPVTPNYVVSQSPRHVVLRNYEGVITTYTEPEDYHEECDCEDCRAGKHKEGVAALSGGQQMALEPSDLARKKRKFDKN

SEQ ID NO: 1313 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1314 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLALEPSDLARKKRKFDKN

SEQ ID NO: 1315 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1316 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRAGKHKEGVAALSGGQQLALEPSDLARKKRKFDKN

SEQ ID NO: 1317 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1318 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPENYHEECDCEDCRAGKHKEGVAALSGGQQLALEPSDLARKKRKFDKN

SEQ ID NO: 1319 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtgattcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1320 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRAGKHREGVAALSGGQQLALEPSDLARKKRKFDKN

SEQ ID NO: 1321 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtgacgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagatggctttagagccttccgacttagctcgcaaaaaacgcaagttcgataagaactaa

SEQ ID NO: 1322 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVTPNYVVSQSPRHVILRNYEGVITTYTEPEDYHEECDCEDCRAGKHKEGVAALSGGQQMALEPSDLARKKRKFDKN

SEQ ID NO: 1323 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgcccctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1324 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVILRNYEGVITTYTEPENYHEECDCEDCRAGKHREGVAALSGGQQLALEPSDLARKKRKFDKN

SEQ ID NO: 1325 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1326 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKSDKN

SEQ ID NO: 1327 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatgtatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1328 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYMYACDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 1329 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgggtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaagtgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctcctcgtcagcgacgaacgcttggaatacatattgaagcgtctgcgcgaaatacctcatgtggagattgttcgtataggaagccgtacgccggtcgtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1330 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLGLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLALEPSDLARKKRKFDKN

SEQ ID NO: 1331 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatcacagtccccacgacatgtggttcttcgcaattatgaaggtgttatcacaacctatacggagccggaggactatcatgaggagtgcgattgtgaggactgtcgagccggtaagcatcgtgagggtgtaaccgcactttccggaggtcagcagttggctttagagccttccgacttagctcgcaaaaaacgcaagttcgataagaactaa

SEQ ID NO: 1332 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVTALSGGQQLALEPSDLARKKRKFDKN

SEQ ID NO: 1333 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggattgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1334 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDCVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLALEPSDLARKKRKFDKN

SEQ ID NO: 1335 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgcccctgaagatatggtagacccacttagtgaagacgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtaaccgcactttccggaggtcagcagatggctttagagccttccgacttagctcgcaaaaaacgcaagttcgataagaactaa

SEQ ID NO: 1336 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVTALSGGQQMALEPSDLARKKRKFDKN

SEQ ID NO: 1337 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaaaaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1338 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEKAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLALEPSDLARKKRKFDKN

SEQ ID NO: 1339 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1340 - protein, 416 aa, Artificial Sequence; identical to SEQ ID NO: 1320
  Description of Artificial Sequence: Synthetic Construct

SEQ ID NO: 1341 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1342 - protein, 416 aa, Artificial Sequence; identical to SEQ ID NO: 1272
  Description of Artificial Sequence: Synthetic Construct

SEQ ID NO: 1343 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1344 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLALEPSDLARKKRKFDKN

SEQ ID NO: 1345 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagatggctttagagccttccgacttagctcgcaaaaaacgcaagttcgataagaactaa

SEQ ID NO: 1346 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQMALEPSDLARKKRKFDKN

SEQ ID NO: 1347 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtaaccgcactttccggaggtcagcagatggctttagagccttccgacttagctcgcaaaaaacgcaagttcgataagaactaa

SEQ ID NO: 1348 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVTALSGGQQMALEPSDLARKKRKFDKN

SEQ ID NO: 1349 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctacactttccggaggtcagcagttggctttagagccttccgacttagctcgcaaaaaacgcaagttcgataagaactaa

SEQ ID NO: 1350 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVATLSGGQQLALEPSDLARKKRKFDKN

SEQ ID NO: 1351 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggaccgtcgagccggtaagcataaagagggtgtagctgcactttccggaggtcagcagttggctttagagccttccgacttagctcgcaaaaaacgcaagttcgataagaactaa

SEQ ID NO: 1352 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDRRAGKHKEGVAALSGGQQLALEPSDLARKKRKFDKN

SEQ ID NO: 1353 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtgacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagatggctttagagccttccgacttagctcgcaaaaaacgcaagttcgataagaactaa

SEQ ID NO: 1354 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVTPNYVVSQSPRHVVLRNYEGVITTYTEPEDYHEECDCEDCRAGKHKEGVAALSGGQQMALEPSDLARKKRKFDKN

SEQ ID NO: 1355 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtaaccgcactttccggaggtcagcagttggctttagagccttccgacttagctcgcaaaaaacgcaagttcgataagaactaa

SEQ ID NO: 1356 - protein, 416 aa, Artificial Sequence; identical to SEQ ID NO: 1306
  Description of Artificial Sequence: Synthetic Construct

SEQ ID NO: 1357 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1358 - protein, 416 aa, Artificial Sequence
  Description of Artificial Sequence: Synthetic Construct
MAESRRKYYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVTTTYTEPEDYHEECDCEDCRAGKHKEGVAALSGGQQLALEPSDLARKKRKLDKN

SEQ ID NO: 1359 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcataaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcggcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctacgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1360 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVGDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKLDKN

SEQ ID NO: 1361 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgtcgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1362 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVTTTYTEPEDYHEECDCEDCRAGKHKEGVAALSGGQQLALEPSDLARKKRKFDKN

SEQ ID NO: 1363 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1364 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKLDKN

SEQ ID NO: 1365 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctcctcctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1366 - protein, 416 aa, Artificial Sequence
  Description of Artificial Sequence: Synthetic Construct
MAESRRKYYFPDVTDEQWYDWHWQVINRIKTLDQLEKYVALTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPPERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1367 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcataaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctacgcagttcctacctttgtggtacatgctccggggggtggtggtaagatacctgtaacgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1368 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVTTTYTEPEDYHEECDCEDCRAGKHKEGVAALSGGQQLALEPSDLARKKRKFDKN

SEQ ID NO: 1369 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctcctcctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtagttcttcgcaattatgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1370 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPPERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1371 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1372 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSFGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLALEPSDLARKKRKFDKN

SEQ ID NO: 1373 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1374 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1375 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaggaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1376 - protein, 416 aa, Artificial Sequence; identical to SEQ ID NO: 1364
  Description of Artificial Sequence: Synthetic Construct

SEQ ID NO: 1377 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtccgttgcactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1378 - protein, 416 aa, Artificial Sequence
  Description of Artificial Sequence: Synthetic Construct
MAESRRKYYFPDVTDEQWYDWHWQVINRIKTLDQLEKSVALTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1379 - DNA, 1251 bp, Artificial Sequence
  Description of Artificial Sequence: Synthetic mutant of Pgaam2 with AAM activity
  CDS (1)..(1251)
atggcagaaagtcgtagaaagtatcatttccctgatgtcaccgatgagcaatggtacgactggcattggcaggtcttaaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1380 - protein, 416 aa, Artificial Sequence
  Description of Artificial Sequence: Synthetic Construct
MAESRRKYHFPDVTDEQWYDWHWQVLNRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKLDKN

SEQ ID NO: 1381 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1382 - protein, 416 aa, Artificial Sequence
  Description of Artificial Sequence: Synthetic Construct
MAESRRKYYFPDVTDEQWYDWHWQVINRIKTLDQLEKYVALTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1383 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 1384 - protein, 416 aa, Artificial Sequence; identical to SEQ ID NO: 946
  Description of Artificial Sequence: Synthetic Construct

SEQ ID NO: 1385 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctacgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaggttcgataagaactaa

SEQ ID NO: 1386 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRRFDKN

SEQ ID NO: 1387 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtccgttgcactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1388 - protein, 416 aa, Artificial Sequence
  Description of Artificial Sequence: Synthetic Construct
MAESRRKYYFPDVTDEQWYDWHWQVINRIKTLDQLEKSVALTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1389 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctacgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgtgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1390 - protein, 416 aa, Artificial Sequence; identical to SEQ ID NO: 946
  Description of Artificial Sequence: Synthetic Construct

SEQ ID NO: 1391 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcttaaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1392 - protein, 416 aa, Artificial Sequence
  Description of Artificial Sequence: Synthetic Construct
MAESRRKYYFPDVTDEQWYDWHWQVLNRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKLDKN

SEQ ID NO: 1393 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacacgctccggggggtggtggtaagatacctgtaacgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1394 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVTTTYTEPEDYHEECDCEDCRAGKHKEGVAALSGGQQLALEPSDLARKKRKFDKN

SEQ ID NO: 1395 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgcgcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtagccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1396 - protein, 416 aa, Artificial Sequence
  Description of Artificial Sequence: Synthetic Construct
MAESRRKYYFPDVTDEQWYDWHWQVINRIKTRDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGSQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1397 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctcctcctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaataggacatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1398 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPPERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1399 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1400 - protein, 416 aa, Artificial Sequence; identical to SEQ ID NO: 946
  Description of Artificial Sequence: Synthetic Construct

SEQ ID NO: 1401 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctacgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1402 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1403 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1404 - protein, 416 aa, Artificial Sequence; identical to SEQ ID NO: 1362
  Description of Artificial Sequence: Synthetic Construct

SEQ ID NO: 1405 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcataaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctcctcctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctacgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1406 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPPERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1407 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcataaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 1408 - protein, 416 aa, Artificial Sequence
  Description of Artificial Sequence: Synthetic Construct
MAESRRKYYFPDVTDEQWYDWHWQVINRIKTLDQLEKYVALTAEEEEGVKESPKVLRMAITPYYLSLIDPENPNCPIRKQAIPTQQELVRSPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1409 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgttgaagaagaagggggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1410 - protein, 416 aa, Artificial Sequence
  Description of Artificial Sequence: Synthetic Construct
MAESRRKYYFPDVTDEQWYDWHWQVINRIKTLDQLEKYVTLTVEEEGGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1411 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcttaaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 1412 - protein, 416 aa, Artificial Sequence
  Description of Artificial Sequence: Synthetic Construct
MAESRRKYYFPDVTDEQWYDWHWQVLNRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVTTTYTEPEDYHEECDCEDCRAGKHKEGVAALSGGQQLALEPSDLARKKRKFDKN

SEQ ID NO: 1413 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcttaaatcggattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1414 - protein, 416 aa, Artificial Sequence
  Description of Artificial Sequence: Synthetic Construct
MAESRRKYYFPDVTDEQWYDWHWQVLNRIKTLDQLEKYVALTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1415 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctacgcagttcctacctttgtggtacatgctccggggggtggtggtaagatacctgtaacgccgaactatgttgtatctcagtccccacgacatgtggtttttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1416 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVFRNYEGVITTYTEPEDYHEECDCEDCRAGKHKEGVAALSGGQQLALEPSDLARKKRKFDKN

SEQ ID NO: 1417 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcataaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgggccggtaagcataaagagggtgtagctgcactttccggaggtcagcagttggctttagagccttccgacttagctcgcaaaaaacgcaagttcgataagaactaa

SEQ ID NO: 1418 - protein, 416 aa, Artificial Sequence; identical to SEQ ID NO: 1402
  Description of Artificial Sequence: Synthetic Construct

SEQ ID NO: 1419 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1420 - protein, 416 aa, Artificial Sequence; identical to SEQ ID NO: 1374
  Description of Artificial Sequence: Synthetic Construct

SEQ ID NO: 1421 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgactatatagccaatacaccgacagtccgcgatgttttgctatcgggaggcgatgcccttcttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1422 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVTTTYTEPEDYHEECDCEDCRAGKHKEGVAALSGGQQLALEPSDLARKKRKLDKN

SEQ ID NO: 1423 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcttaaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctacgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1424 - protein, 416 aa, Artificial Sequence
  Description of Artificial Sequence: Synthetic Construct
MAESRRKYYFPDVTDEQWYDWHWQVLNRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1425 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtccgttgcactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctacgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 1426 - protein, 416 aa, Artificial Sequence; identical to SEQ ID NO: 1388
  Description of Artificial Sequence: Synthetic Construct

SEQ ID NO: 1427 - DNA, 1251 bp, Artificial Sequence
  Description of Artificial Sequence: Synthetic mutant of Pgaam2 with AAM activity
  CDS (1)..(1251)
atggcagaaagccgtagaaagtattatttccctgatgtcaccgatgagcaatggtacgactggcattggcaggtcttaaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgactatatagccaatacaccgacagtccgcgatgttttgctatcgggaggcgatgcccttcttgtcggcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 1428 - protein, 416 aa, Artificial Sequence
  Description of Artificial Sequence: Synthetic Construct
MAESRRKYYFPDVTDEQWYDWHWQVLNRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGRKDASSPSERIDRCIDYIANTPTVRDVLLSGGDALLVGDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1429 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcataaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctcctcctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctacgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1430 - protein, 416 aa, Artificial Sequence; identical to SEQ ID NO: 1406
  Description of Artificial Sequence: Synthetic Construct

SEQ ID NO: 1431 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctacgcagttcctacctttgtggtacatgctccggggggtggtggtaagatacctgtaacgccgaactatgttgtatctcagtccccgcgacatgtggttcttcgcaattatgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1432 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1433 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtccattgcactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgcccttcttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1434 - protein, 416 aa, Artificial Sequence
  Description of Artificial Sequence: Synthetic Construct
MAESRRKYYFPDVTDEQWYDWHWQVINRIKTLDQLEKSIALTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1435 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1436 - protein, 416 aa, Artificial Sequence; identical to SEQ ID NO: 1362
  Description of Artificial Sequence: Synthetic Construct

SEQ ID NO: 1437 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1438 - protein, 416 aa, Artificial Sequence; identical to SEQ ID NO: 946
  Description of Artificial Sequence: Synthetic Construct

SEQ ID NO: 1439 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctacgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1440 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKLDKN

SEQ ID NO: 1441 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1442 - protein, 416 aa, Artificial Sequence; identical to SEQ ID NO: 1432
  Description of Artificial Sequence: Synthetic Construct

SEQ ID NO: 1443 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccgcgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1444 - protein, 416 aa, Artificial Sequence
  Description of Artificial Sequence: Synthetic Construct
MAESRRKYYFPDVTDEQWYDWHWQVINRIKTLDQLEKYVALTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVTTTYTEPEDYHEECDCEDCRAGKHKEGVAALSGGQQLALEPSDLARKKRKFDKN

SEQ ID NO: 1445 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcataaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctacgcagttcctacctttgtggtacatgctccggggggtggtggtaagatacctgtaacgccgaactatgttgtatctcagtccccacgacatgtggttcttcgcaattatgaaggtgttatcacgacctatacggagccggaggactatcatgaggagtgcgattgtgaggactgtcgagtcggtaagcataaagagggtgtagctgcactttccggaggtcagcagttggctttagagccttccgacttagctcgcaaaaaacgcaagttcgataagaactaa

SEQ ID NO: 1446 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMASAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVGKHKEGVAALSGGQQLALEPSDLARKKRKFDKN

SEQ ID NO: 1447 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctacgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1448 - protein, 416 aa, Artificial Sequence; identical to SEQ ID NO: 1440
  Description of Artificial Sequence: Synthetic Construct

SEQ ID NO: 1449 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1450 - protein, 416 aa, Artificial Sequence; identical to SEQ ID NO: 1374
  Description of Artificial Sequence: Synthetic Construct

SEQ ID NO: 1451 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaataggacatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1452 - protein, 416 aa, Artificial Sequence; identical to SEQ ID NO: 1440
  Description of Artificial Sequence: Synthetic Construct

SEQ ID NO: 1453 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgcccttcttgtcggcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1454 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVGDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKLDKN

SEQ ID NO: 1455 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacacccaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcggcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 1456 - protein, 416 aa, Artificial Sequence
  Description of Artificial Sequence: Synthetic Construct
MAESRRKYYFPDVTDEQWYDWHWQVINRIKTLDQLEKYVTPTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVGDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1457 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacgcatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1458 - protein, 416 aa, Artificial Sequence; identical to SEQ ID NO: 1402
  Description of Artificial Sequence: Synthetic Construct

SEQ ID NO: 1459 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatccattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgagctatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1460 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRSIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPSYVVSQSPRHVVLRNYEGVITTYTEPEDYHEECDCEDCRAGKHKEGVAALSGGQQLALEPSDLARKKRKFDKN

SEQ ID NO: 1461 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1462 - protein, 416 aa, Artificial Sequence; identical to SEQ ID NO: 1440
  Description of Artificial Sequence: Synthetic Construct

SEQ ID NO: 1463 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctacgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1464 - protein, 416 aa, Artificial Sequence; identical to SEQ ID NO: 946
  Description of Artificial Sequence: Synthetic Construct

SEQ ID NO: 1465 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctacgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1466 - protein, 416 aa, Artificial Sequence; identical to SEQ ID NO: 1432
  Description of Artificial Sequence: Synthetic Construct

SEQ ID NO: 1467 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccgaaggactatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 1468 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPKDYHEECDCEDCRAGKHKEGVAALSGGQQLALEPSDLARKKRKFDKN

SEQ ID NO: 1469 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcttaaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcggcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1470 - protein, 416 aa, Artificial Sequence
  Description of Artificial Sequence: Synthetic Construct
MAESRRKYYFPDVTDEQWYDWHWQVLNRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVGDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKLDKN

SEQ ID NO: 1471 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcaccaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgcccttcttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 1472 - protein, 416 aa, Artificial Sequence
  Description of Artificial Sequence: Synthetic Construct
MAESRRKYYFPDVTDEQWYDWHWQVTNRIKTLDQLEKYVALTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKLDKN

SEQ ID NO: 1473 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcataaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagacgcttcttctcctcctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1474 - protein, 416 aa, Artificial Sequence; identical to SEQ ID NO: 1370
  Description of Artificial Sequence: Synthetic Construct

SEQ ID NO: 1475 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaagatacctgtaacgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagtttgataagaactaa

SEQ ID NO: 1476 - protein, 416 aa, Artificial Sequence; identical to SEQ ID NO: 1394
  Description of Artificial Sequence: Synthetic Construct

SEQ ID NO: 1477 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctggagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagcctcccgacttagctcgcaaaaaacgcaagttcgataagaactaa

SEQ ID NO: 1478 - protein, 416 aa, Artificial Sequence
  Description of Artificial Sequence: Synthetic Construct
MAESRRKYYFPDVTDEQWYDWHWQVINRIKTLDQLEKYVTLTAGEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPPDLARKKRKFDKN

SEQ ID NO: 1479 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttctgctatcgggaggcgatgccctccttgtcagcgacgaacgcttggaatacatcttgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1480 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1481 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacccttgtggtacatgctccggggggtggtggtaagatacctgtaacgccgaactatgttgtatctcagtccccacgacatgtggtccttcgcaattatgaaggtgttatcacaacctatacggagccggaggactatcatgaggagtgcgattgtgaggactgccgagccggtaagcataaagagggtgtagctgcactttccggaggtcagcagttggctttagagcctcccgacttagctcgcaaaaaacgcaagttcgataagaactaa

SEQ ID NO: 1482 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTLVVHAPGGGGKIPVTPNYVVSQSPRHVVLRNYEGVITTYTEPEDYHEECDCEDCRAGKHKEGVAALSGGQQLALEPPDLARKKRKFDKN

SEQ ID NO: 1483 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgagttaagacgctcgaccagctggagaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttaatgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacccttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccggtaagcataaagagggtgtagctgcactttccggaggtcagcagttggctttagagcctcccgacttagctcgcaaaaaacgcaagttcgataagaactaa

SEQ ID NO: 1484 - protein, 416 aa, Artificial Sequence
  Description of Artificial Sequence: Synthetic Construct
MAESRRKYYFPDVTDEQWYDWHWQVINRVKTLDQLEKYVTLTAEEEEGVKESPKVLRMAITPYYLSLIDPENPNCPIRKQAIPTQQELVRAPEDMVDPLNEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTLVVHAPGGGGKIPVTPNYVVSQSPRHVVLRNYEGVITTYTEPEDYHEECDCEDCRAGKHKEGVAALSGGQQLALEPPDLARKKRKFDKN

SEQ ID NO: 1485 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctagttgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccggtaagcataaagagggtgtggctgcactttccggaggtcagcagttggctttagaaccttccgacttagctcgcaaaaaacgcaagttcgataagaactaa

SEQ ID NO: 1486 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPSCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1487 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacccttgtcgtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagaaccttccgacttagctcgcaaaaaacgcaagttcgataagaactaa

SEQ ID NO: 1488 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTLVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1489 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagccttccgacttagctcgcaaaaaacgcaagttcgataagaactaa

SEQ ID NO: 1490 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPSDLARKKRKFDKN

SEQ ID NO: 1491 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1492 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSMGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 1493 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgagtatatagccaatacaccgacggtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccgacaagcataaagagggtgtagctgcactttccgaaggtcagcagttggctttagagccttccgacttagctcgcaaaaaacgcaagttcgataagaactaa

SEQ ID NO: 1494 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSEGQQLALEPSDLARKKRKFDKN

SEQ ID NO: 1495 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccgacaagcataaagagggtgtagctgcactttccggaggtcagcagttggctttagagcctcccgacttagctcgcaaaaaacgcaagttcgataagaactaa

SEQ ID NO: 1496 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 1497 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattggagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggagtagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1498 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILERLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGVGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1499 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagttcgataagaactaa

SEQ ID NO: 1500 - protein, 416 aa, Artificial Sequence; identical to SEQ ID NO: 946
  Description of Artificial Sequence: Synthetic Construct

SEQ ID NO: 1501 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacccttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1502 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTLVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1503 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctacactttccggaggtcagcagttggctttagaaccttccgacttagctcgcaaaaaacgcaagttcgataagaactaa

SEQ ID NO: 1504 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVATLSGGQQLALEPSDLARKKRKFDKN

SEQ ID NO: 1505 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1506 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1507 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccggtaagcataaagagggtgtggctgcactttccggaggtcagcagttggctttagagcctcccgacttagctcgcaaaaaacgcaagttcgataagaactaa

SEQ ID NO: 1508 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPPDLARKKRKFDKN

SEQ ID NO: 1509 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagaaccttccgacttagctcgcaaaaaacgcaagttcgataagaactaa

SEQ ID NO: 1510 - protein, 416 aa, Artificial Sequence; identical to SEQ ID NO: 946
  Description of Artificial Sequence: Synthetic Construct

SEQ ID NO: 1511 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctacactttccggaggtcagcagttggctttagagccttccgacttagctcgcaaaaaacgcaagttcgataagaactaa

SEQ ID NO: 1512 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVATLSGGQQLALEPSDLARKKRKFDKN

SEQ ID NO: 1513 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccggtaagcataaagagggtgtagctgcactttccggaggtcagcagttggctttagagccttccgacttagctcgcaaaaaacgcaagttcgataagaactaa

SEQ ID NO: 1514 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1515 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1516 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSFGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1517 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaataccatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaggagggtgtagctgcactttccggaggtcagcagttggctttagagccttccgacttagctcgcaaaaaacgcaagttcgataagaactaa

SEQ ID NO: 1518 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPSDLARKKRKFDKN

SEQ ID NO: 1519 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagaaccttccgacttagctcgcaaaaaacgcaagttcgataagaactaa

SEQ ID NO: 1520 - protein, 416 aa, Artificial Sequence; identical to SEQ ID NO: 1514
  Description of Artificial Sequence: Synthetic Construct

SEQ ID NO: 1521 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1522 - protein, 416 aa, Artificial Sequence; identical to SEQ ID NO: 946
  Description of Artificial Sequence: Synthetic Construct

SEQ ID NO: 1523 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctacactttccggaggtcagcagttggctttagagccttccgacttagctcgcaaaaaacgcaagttcgataagaactaa

SEQ ID NO: 1524 - protein, 416 aa, Artificial Sequence; identical to SEQ ID NO: 1512
  Description of Artificial Sequence: Synthetic Construct

SEQ ID NO: 1525 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaatcatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1526 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNHEGVITTYTEPEDYHEECDCEDCRAGKHKEGVAALSGGQQLALEPSDLARKKRKFDKN

SEQ ID NO: 1527 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagcctcccgacttagctcgcaaaaaacgcaagttcgataagaactaa

SEQ ID NO: 1528 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPPDLARKKRKFDKN

SEQ ID NO: 1529 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatggggagtgcgattgtgaggactgccgagccggtaagcataaagagggtgtagctgcactttccggaggtcagcagttggctttagagccttccgacttagctcgcaaaaaacgcaagttcgataagaactaa

SEQ ID NO: 1530 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHGECDCEDCRAGKHKEGVAALSGGQQLALEPSDLARKKRKFDKN

SEQ ID NO: 1531 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1532 - protein, 416 aa, Artificial Sequence; identical to SEQ ID NO: 946
  Description of Artificial Sequence: Synthetic Construct

SEQ ID NO: 1533 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1534 - protein, 416 aa, Artificial Sequence; identical to SEQ ID NO: 1514
  Description of Artificial Sequence: Synthetic Construct

SEQ ID NO: 1535 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacccttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagaaccttccgacttagctcgcaaaaaacgcaagttcgataagaactaa

SEQ ID NO: 1536 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTLVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1537 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccgacaagcataaagagggtgtggctgcactttccggaggtcagcagttggctttagaaccttccgacttagctcgcaaaaaacgcaagttcgataagaactaa

SEQ ID NO: 1538 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPSDLARKKRKFDKN

SEQ ID NO: 1539 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctacactttccggaggtcagcagttggctttagagcctcccgacttagctcgcaaaaaacgcaagttcgataagaactaa

SEQ ID NO: 1540 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVATLSGGQQLALEPPDLARKKRKFDKN

SEQ ID NO: 1541 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatcttgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagaacctcccgacttagctcgcaaaaaacgcaagttcgataagaactaa

SEQ ID NO: 1542 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPPDLARKKRKFDKN

SEQ ID NO: 1543 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagaacctcccgacttagctcgcaaaaaacgcaagttcgataagaactaa

SEQ ID NO: 1544 - protein, 416 aa, Artificial Sequence; identical to SEQ ID NO: 1508
  Description of Artificial Sequence: Synthetic Construct

SEQ ID NO: 1545 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacccttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccgacaagcataaagagggtgtagctgcactttccggaggtcagcagttggctttagaaccttccgacttagctcgcaaaaaacgcaagttcgataagaactaa

SEQ ID NO: 1546 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTLVVHAPGGGGKIPVTPNYVVSQSPRHVVLRNYEGVITTYTEPEDYHEECDCEDCRADKHKEGVAALSGGQQLALEPSDLARKKRKFDKN

SEQ ID NO: 1547 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccggtaagcataaagagggtgtagctgcactttccggaggtcagcagttggctttagagccttccgacttagctcgcaaaaaacgcaagttcgataagaactaa

SEQ ID NO: 1548 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1549 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacccttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccggtaagcataaagagggtgtagctgcactttccggaggtcagcagttggctttagagcctcccgacttagctcgcaaaaaacgcaagttcgataagaactaa

SEQ ID NO: 1550 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVAEEAVEACERMANAGIPLGNQTVLLRGINDCTHVMKRLVHLLVKIRVRPYYIYACDLSLGIGHFRTPVSKGIEIIENLRGHTSGYAVPTLVVHAPGGGGKIPVTPNYVVSQSPRHVVLRNYEGVITTYTEPEDYHEECDCEDCRAGKHKEGVAALSGGQQLALEPPDLARKKRKFDKN

SEQ ID NO: 1551 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgagccggtaagcataaagagggtgtggctgcactttccggaggtcagcagttggctttagagccttccgacttagctcgcaaaaaacgcaagttcgataagaactaa

SEQ ID NO: 1552 - protein, 416 aa, Artificial Sequence; identical to SEQ ID NO: 1514
  Description of Artificial Sequence: Synthetic Construct

SEQ ID NO: 1553 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagaacctcccgacttagctcgcaaaaaacgcaagttcgataagaactaa

SEQ ID NO: 1554 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPPDLARKKRKFDKN

SEQ ID NO: 1555 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1556 - protein, 416 aa, Artificial Sequence; identical to SEQ ID NO: 946
  Description of Artificial Sequence: Synthetic Construct

SEQ ID NO: 1557 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacccttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1558 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTLVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1559 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgatgggaatagggcatttccgcacgccggtatctaaaggaatcgaaattaccgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagaaccttccgacttagctcgcaaaaaacgcaagttcgataagaactaa

SEQ ID NO: 1560 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSMGIGHFRTPVSKGIEITENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1561 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1562 - protein, 416 aa, Artificial Sequence; identical to SEQ ID NO: 946
  Description of Artificial Sequence: Synthetic Construct

SEQ ID NO: 1563 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtagctgcactttccggaggtcagcagttggctttagagccttccgacttagctcgcaaaaaacgcaagttcgataagaactaa

SEQ ID NO: 1564 - protein, 416 aa, Artificial Sequence; identical to SEQ ID NO: 1518
  Description of Artificial Sequence: Synthetic Construct

SEQ ID NO: 1565 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctggagaagtacgttacactcaccgctgaagaggaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagttcgataagaactaa

SEQ ID NO: 1566 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1567 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgatgggaatagggcatttccgcacgccggtatctaaaggaatcgaaattatcgaaaatttgcgcggacatacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1568 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1569 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1570 - protein, 416 aa, Artificial Sequence; identical to SEQ ID NO: 946
  Description of Artificial Sequence: Synthetic Construct

SEQ ID NO: 1571 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1572 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1573 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacgtgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1574 - protein, 416 aa, Artificial Sequence
  Description of Artificial Sequence: Synthetic Construct
MAESRRKHYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRRVVLRNYEGVITTYTEPEDYHEECDCEDCRAGKHKEGVAALSGGQQLALEPSDLARKKRKFDKN

SEQ ID NO: 1575 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1576 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1577 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcttccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1578 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVFPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1579 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1580 - protein, 416 aa, Artificial Sequence
  Description of Artificial Sequence: Synthetic Construct
MAESRRKHYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1581 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgtacgccggtatccaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1582 - protein, 416 aa, Artificial Sequence; identical to SEQ ID NO: 1576
  Description of Artificial Sequence: Synthetic Construct

SEQ ID NO: 1583 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1584 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1585 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccctgagaatcctaattgtccgattcgtaaacaagccattcctactcgacaggaactggtacgtgctcctgaagatatggtagacccacttagtgaagatgaagattcgcccgtacccggactgactcatcgttacccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1586 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1587 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggcagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1588 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPAVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1589 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaagcgcaagttcgataagaactaa

SEQ ID NO: 1590 - protein, 416 aa, Artificial Sequence
  Description of Artificial Sequence: Synthetic Construct
MAESRRKHYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1591 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggtggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgatatgaactaa

SEQ ID NO: 1592 - protein, 416 aa, Artificial Sequence
  Description of Artificial Sequence: Synthetic Construct
MAESRRKHYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVVACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDMN

SEQ ID NO: 1593 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaagaacgcaagttcgataagaactaa

SEQ ID NO: 1594 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKERKFDKN

SEQ ID NO: 1595 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgacgaagaagagggggtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1596 - protein, 416 aa, Artificial Sequence
  Description of Artificial Sequence: Synthetic Construct
MAESRRKHYFPDVTDEQWYDWHWQVINRIKTLDQLEKYVTLTADEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1597 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1598 - protein, 416 aa, Artificial Sequence; identical to SEQ ID NO: 946
  Description of Artificial Sequence: Synthetic Construct

SEQ ID NO: 1599 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgatatgaactaa

SEQ ID NO: 1600 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDMN

SEQ ID NO: 1601 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaactgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgatatgaactaa

SEQ ID NO: 1602 - protein, 416 aa, Artificial Sequence
  Description of Artificial Sequence: Synthetic Construct
MAESRRKHYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDMN

SEQ ID NO: 1603 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaactatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1604 - protein, 416 aa, Artificial Sequence; identical to SEQ ID NO: 946
  Description of Artificial Sequence: Synthetic Construct

SEQ ID NO: 1605 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccaattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcatcgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1606 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1607 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1608 - protein, 416 aa, Artificial Sequence; identical to SEQ ID NO: 1584
  Description of Artificial Sequence: Synthetic Construct

SEQ ID NO: 1609 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtgagcataaagagggcgtagctgcactttccggaggtcagcagttggctttagagccttccgacttagctcgcaaaaaacgcaagttcgataagaactaa

SEQ ID NO: 1610 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGEHKEGVAALSGGQQLALEPSDLARKKRKFDKN

SEQ ID NO: 1611 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1612 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1613 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1614 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1615 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgacgaagaagagggagtaaaagaatcacccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1616 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1617 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgacgaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgatatgaactaa

SEQ ID NO: 1618 - protein, 416 aa, Artificial Sequence
  Description of Artificial Sequence: Synthetic Construct
MAESRRKHYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDMN

SEQ ID NO: 1619 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1620 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1621 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1622 - protein, 416 aa, Artificial Sequence; identical to SEQ ID NO: 1576
  Description of Artificial Sequence: Synthetic Construct

SEQ ID NO: 1623 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtatttcgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1624 - protein, 416 aa, Artificial Sequence
  Description of Artificial Sequence: Synthetic Construct
MAESRRKHYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGISLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1625 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1626 - protein, 416 aa, Artificial Sequence; identical to SEQ ID NO: 1614
  Description of Artificial Sequence: Synthetic Construct

SEQ ID NO: 1627 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgatatgaactaa

SEQ ID NO: 1628 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDMN

SEQ ID NO: 1629 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1630 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1631 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttaccacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1632 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVTTTYTEPEDYHEECDCEDCRAGKHKEGVAALSGGQQLALEPSDLARKKRKFDKN

SEQ ID NO: 1633 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcactgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1634 - protein, 416 aa, Artificial Sequence; identical to SEQ ID NO: 1590
  Description of Artificial Sequence: Synthetic Construct

SEQ ID NO: 1635 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagaccctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaggccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactacatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1636 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1637 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgacgaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1638 - protein, 416 aa, Artificial Sequence
  Description of Artificial Sequence: Synthetic Construct
MAESRRKHYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1639 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1640 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1641 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgatatgaactaa

SEQ ID NO: 1642 - protein, 416 aa, Artificial Sequence; identical to SEQ ID NO: 1600
  Description of Artificial Sequence: Synthetic Construct

SEQ ID NO: 1643 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgacgaagaagagggggtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1644 - protein, 416 aa, Artificial Sequence; identical to SEQ ID NO: 1630
  Description of Artificial Sequence: Synthetic Construct

SEQ ID NO: 1645 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgacgaagaagagggggtaaaagaatcgcccaaagtactccgaatggctatcacaccttattatttgagtttgatagaccccgagaatcctaattgtccgattcgtaaacaagctattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1646 - protein, 416 aa, Artificial Sequence; identical to SEQ ID NO: 1580
  Description of Artificial Sequence: Synthetic Construct

SEQ ID NO: 1647 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1648 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRAGKHKEGVAALSGGQQLALEPSDLARKKRKFDKN

SEQ ID NO: 1649 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgacgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1650 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1651 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcactgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1652 - protein, 416 aa, Artificial Sequence; identical to SEQ ID NO: 1650
  Description of Artificial Sequence: Synthetic Construct

SEQ ID NO: 1653 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgtcacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1654 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1655 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1656 - protein, 416 aa, Artificial Sequence; identical to SEQ ID NO: 1584
  Description of Artificial Sequence: Synthetic Construct

SEQ ID NO: 1657 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1658 - protein, 416 aa, Artificial Sequence; identical to SEQ ID NO: 1606
  Description of Artificial Sequence: Synthetic Construct

SEQ ID NO: 1659 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1660 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRAGKHKEGVAALSGGQQLALEPSDLARKKRKFDKN

SEQ ID NO: 1661 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgatatgaactaa

SEQ ID NO: 1662 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDMN

SEQ ID NO: 1663 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgacgaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggcaaccaaacggttttattgcgtggaatcaatgattgtacacacgtgatgaagagattggtacatttgctggtaaagatgcgtgtgcgtccttactatatatatgcttgcgatctttcgcttggaatagggcatttccgtacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcggcagttggctttagagccttccgacttagctcgcaaaaaacgcaagttcgataagaactaa

SEQ ID NO: 1664 - protein, 416 aa, Artificial Sequence
  Description of Artificial Sequence: Synthetic Construct
MAESRRKYYFPDVTDEQWYDWHWQVINRIKTLDQLEKYVTLTADEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGRQLALEPSDLARKKRKFDKN

SEQ ID NO: 1665 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaatcaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatattatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1666 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYYPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1667 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccgacaagcataaagagggtgtagctgcactttccggaggtcagcagttggctttagagccttccgacttagctcgcaaaaaacgcaagttcgataagaactaa

SEQ ID NO: 1668 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPSDLARKKRKFDKN

SEQ ID NO: 1669 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacccttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1670 - protein, 416 aa, Artificial Sequence; identical to SEQ ID NO: 1536
  Description of Artificial Sequence: Synthetic Construct

SEQ ID NO: 1671 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagcgaagatgaagattcgcccgtacccggactgactcatcgttatccggatcgtgtattgttccttatcacggacaaatgttcgatgtactgtcgtcattgtactcgccgtcgcttcgcaggacagaaagatgctccttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggaccgtcgagccggtaagcataaagagggtgtagctgcactttccggaggtcagcagttggctttagagccttccgacttagctcgcaaaaaacgcaagttcgataagaactaa

SEQ ID NO: 1672 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDAPSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDRRAGKHKEGVAALSGGQQLALEPSDLARKKRKFDKN

SEQ ID NO: 1673 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggccatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaacggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1674 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERTANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1675 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccgacaagcataaagagggtgtagctgcactttccggaggtcagcagttggctttagagccttccgacttagctcgcaaaaaacgcaagttcgataagaactaa

SEQ ID NO: 1676 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPSDLARKKRKFDKN

SEQ ID NO: 1677 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgatgattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1678 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDDDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1679 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcagcgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1680 - protein, 416 aa, Artificial Sequence
  Description of Artificial Sequence: Synthetic Construct
MAESRRKHYFPDVSDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1681 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1682 - protein, 416 aa, Artificial Sequence; identical to SEQ ID NO: 946
  Description of Artificial Sequence: Synthetic Construct

SEQ ID NO: 1683 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaaccgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggtccttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1684 - protein, 416 aa, Artificial Sequence; identical to SEQ ID NO: 1606
  Description of Artificial Sequence: Synthetic Construct

SEQ ID NO: 1685 - DNA, 1251 bp, Artificial Sequence
  Description of Artificial Sequence: Synthetic mutant of Pgaam2 with AAM activity
  CDS (1)..(1251)
atggcagaaagtcgtagaaagtactatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1686 - protein, 416 aa, Artificial Sequence; identical to SEQ ID NO: 946
  Description of Artificial Sequence: Synthetic Construct

SEQ ID NO: 1687 - DNA, 1251 bp, Artificial Sequence
  Description of Artificial Sequence: Synthetic mutant of Pgaam2 with AAM activity
  CDS (1)..(1251)
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccagtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtagctgcactttccggaggtcagcagttggctttagagccttccgacttagctcgcaaaaaacgcaagttcgataagaactaa

SEQ ID NO: 1688 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1689 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgtttggaatacatattgaagcgtctgcgcgaagtacctcatgtggagattgtacgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1690 - protein, 416 aa, Artificial Sequence; identical to SEQ ID NO: 946
  Description of Artificial Sequence: Synthetic Construct

SEQ ID NO: 1691 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1692 - protein, 416 aa, Artificial Sequence; identical to SEQ ID NO: 1660
  Description of Artificial Sequence: Synthetic Construct

SEQ ID NO: 1693 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtacctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1694 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVPKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1695 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggtcttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagaacctcccgacttagctcgcaaaaaacgcaagttcgataagaactaa

SEQ ID NO: 1696 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPPDLARKKRKFDKN

SEQ ID NO: 1697 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagcctcccgacttagctcgcaaaaaacgcaagttcgataagaactaa

SEQ ID NO: 1698 - protein, 416 aa, Artificial Sequence; identical to SEQ ID NO: 1696
  Description of Artificial Sequence: Synthetic Construct

SEQ ID NO: 1699 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccgacaagcataaagagggtgtagctgcactttccggaggtcagcagttggctttagagcctcccgacttagctcgcaaaaaacgcaagttcgataagaactaa

SEQ ID NO: 1700 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 1701 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1702 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1703 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctacactttccggaggtcagcagttggctttagagccttccgacttagctcgcaaaaaacgcaagttcgataagaactaa

SEQ ID NO: 1704 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVATLSGGQQLALEPSDLARKKRKFDKN

SEQ ID NO: 1705 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgttgaagagattggtacatttgctggtgaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagcctcccgacttagctcgcaaaaaacgcaagttcgataagaactaa

SEQ ID NO: 1706 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVLKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPPDLARKKRKFDKN

SEQ ID NO: 1707 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagtccctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagaacctcccgacttagctcgcaaaaaacgcaagttcgataagaactaa

SEQ ID NO: 1708 - protein, 416 aa, Artificial Sequence; identical to SEQ ID NO: 1696
  Description of Artificial Sequence: Synthetic Construct

SEQ ID NO: 1709 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagcctcccgacttagctcgcaaaaaacgcaagttcgataagaactaa

SEQ ID NO: 1710 - protein, 416 aa, Artificial Sequence; identical to SEQ ID NO: 1508
  Description of Artificial Sequence: Synthetic Construct

SEQ ID NO: 1711 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggccatcacaccttattatttgagcttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagcctcccgacttagctcgcaaaaaacgcaagttcgataagaactaa

SEQ ID NO: 1712 - protein, 416 aa, Artificial Sequence; identical to SEQ ID NO: 1696
  Description of Artificial Sequence: Synthetic Construct

SEQ ID NO: 1713 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccgacaagcataaagagggtgtagctgcactttccggaggtcagcagttggctttagaacctcccgacttagctcgcaaaaaacgcaggttcgataagaactaa

SEQ ID NO: 1714 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRRFDKN

SEQ ID NO: 1715 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacaccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1716 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLALEPSDLARKKRKFDKN

SEQ ID NO: 1717 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgctccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1718 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLLLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKSDKN

SEQ ID NO: 1719 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1720 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKSDKN

SEQ ID NO: 1721 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1722 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPENYHEECDCEDCRAGKHKEGVAALSGGQQLALEPSDLARKKRKFDKN

SEQ ID NO: 1723 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcatgggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1724 - protein, 416 aa, Artificial Sequence
  Description of Artificial Sequence: Synthetic Construct
MAESRRKYYFPDVTDEQWYDWHGQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 1725 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1726 - protein, 416 aa, Artificial Sequence
  Description of Artificial Sequence: Synthetic Construct
MAESRRKYYFPDVTDEQWYDWHWQVINRIKTLDQLEKYVALTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVILRNYEGVITTYTEPENYHEECDCEDCRAGKHKEGVAALSGGQQLALEPSDLARKKRKSDKN

SEQ ID NO: 1727 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagtgcatgacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1728 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQCMTPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPENYHEECDCEDCRAGKHKEGVAALSGGQQLALEPSDLARKKRKFDKN

SEQ ID NO: 1729 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgctacgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggcacatgctccggggggtggtggtaagatacctgtggcgccgaactatgttgtatctcagtccccacgacatgtggttctccgcaattatgaaggtgttatcacaacctatacggagccggagaattatcatgaggagtgcgattgtgaggactgtcgggccggtaagcataaagagggtgtagctgcactttccggaggtcagcagttggctttagagccttccgacttagctcgcaaaaaacgcaagttcgataagaactaa

SEQ ID NO: 1730 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVAHAPGGGGKIPVAPNYVVSQSPRHVVLRNYEGVITTYTEPENYHEECDCEDCRAGKHKEGVAALSGGQQLALEPSDLARKKRKFDKN

SEQ ID NO: 1731 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacaccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1732 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLALEPSDLARKKRKSDKN

SEQ ID NO: 1733 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1734 - protein, 416 aa, Artificial Sequence; identical to SEQ ID NO: 1318
  Description of Artificial Sequence: Synthetic Construct

SEQ ID NO: 1735 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtactccgaatggctatcacaccttattatttgagtttgatagaccctgagaatcctagttgtccgattcgtaaacaagccattcctactcaacgggaactggtacgtgctcctgaagatatggtagacccacttagtgaagatgaagattcgcccgtacccgggctgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgccggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1736 - protein, 416 aa, Artificial Sequence
  Description of Artificial Sequence: Synthetic Construct
MAESRRKYYFPDVTDEQWYDWHWQVINRIKTLDQLEKYVTLTAEEEEGAKESPKVLRMAITPYYLSLIDPENPSCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLPVKMRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRAGKHKEGVAALSGGQQLALEPSDLARKKRKSDKN

SEQ ID NO: 1737 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtacctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1738 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVPKGIEIIENLRGHTSGYAVPTFVVHAPGGGGKIPVTPNYVVSQSPRHVVLRNYEGVITTYTEPENYHEECDCEDCRAGKHKEGVAALSGGQQLALEPSDLARKKRKFDKN

SEQ ID NO: 1739 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttgtccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1740 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRCPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKSDKN

SEQ ID NO: 1741 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgtttgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacaccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgctcggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcaatccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1742 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCLMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRAGKHKEGVAALSGGQQLALEPSDLARKKRKFDKN

SEQ ID NO: 1743 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgtttcgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 1744 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVSLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRAGKHKEGVAALSGGQQLALEPSDLARKKRKFDKN

SEQ ID NO: 1745 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccccgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtaccgggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1746 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPENYHEECDCEDCRAGKHKEGVAALSGGQQLALEPSDLARKKRKSDKN

SEQ ID NO: 1747 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacaccggtagtcctccctcagcgtataacgcctcaattggtggatatgctcaaaaagtatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagatgcgtgtgcgtccttactatatgtatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1748 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACGRMANAGIPLGNQTVLLRGINDCTHVMKRLVHLLVKMRVRPYYMYACDLSLGIGHFRTPVSKGIEIIENLRGHTSGYAVPTFVVHAPGGGGKIPVAPNYVVSQSPRHVVLRNYEGVITTYTEPENYHEECDCEDCRAGKHKEGVAALSGGQQLALEPSDLARKKRKSDKN

SEQ ID NO: 1749 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaattatcatgaggagtacgattgtgaggactgtcgagccggtaagcataaagagggtgtagctgcactttccggaggtcagcagttggctttagagccttccgacttagctcgcaaaaaacgcaagagcgataagaactaa

SEQ ID NO: 1750 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVTPNYVVSQSPRHVVLRNYEGVITTYTEPENYHEEYDCEDCRAGKHKEGVAALSGGQQLALEPSDLARKKRKSDKN

SEQ ID NO: 1751 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1752 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRKFDKN

SEQ ID NO: 1753 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcgtgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctacacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1754 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPRVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRKFDKN

SEQ ID NO: 1755 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctgttaaagatgcgtgtgcgtccttactatatatatgcttgcgatctttcgcttggaatagggcatttccgcacgccggtgtctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgactcagctcgcaaaaaacgcaagttcgataagaactaa

SEQ ID NO: 1756 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLLKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQLALEPSDSARKKRKFDKN

SEQ ID NO: 1757 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtgcctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatggggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1758 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGMGHFRTPVSKGIEIIENLRGHTSGYAVPTFVVHAPGGGGKIPVAPNYVVSQSPRHVVLRNYEGVITTYTEPENYHEECDCEDCRAGKHREGVAALSGGQQLALEPSDLARKKRKFDKN

SEQ ID NO: 1759 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccactcctactaaacaggaactggtacgtgctcctgaagatatggtagacccgcttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1760 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQATPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1761 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcccgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1762 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPENYHEECDCEDCRAGKHREGVAALSGGQQLALEPSDLARKKRKFDKN

SEQ ID NO: 1763 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggccgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1764 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWPNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRKFDKN

SEQ ID NO: 1765 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtgaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgagggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1766 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIREQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQLALEPSDLARKKRKFDKN

SEQ ID NO: 1767 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcactccaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttggctcgcaaaaaacgcaagttcgataagaactaa

SEQ ID NO: 1768 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHSNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQLALEPSDLARKKRKFDKN

SEQ ID NO: 1769 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1770 - protein, 416 aa, Artificial Sequence; identical to SEQ ID NO: 1752
  Description of Artificial Sequence: Synthetic Construct

SEQ ID NO: 1771 - DNA, 1251 bp, Porphyromonas gingivalis
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccatttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagtcggtaagcatcatgagggtgtagctgcactttccggaggtcagccgttggctttagagccttccgacttagctcgcaaaaaacgcaagttcgataagaactaa

SEQ ID NO: 1772 - protein, 416 aa, Porphyromonas gingivalis
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPFSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRVGKHHEGVAALSGGQPLALEPSDLARKKRKFDKN

SEQ ID NO: 1773 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacacccaccgctgaggaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccagcgagtgaagatgaagattcgcccgtacccggactgactcatcgttatccggatcgtgttttgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1774 - protein, 416 aa, Artificial Sequence
  Description of Artificial Sequence: Synthetic Construct
MAESRRKYYFPDVTDEQWYDWHWQVINRIKTLDQLEKYVTPTAEEEEGVKESPKVLRMAITPYYLSLIDPENPNCPIRKQAIPTKQELVRAPEDMVDPASEDEDSPVPGLTHRYPDRVLFLITDKCSMYCRHCTRRRFAGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1775 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccatttagtgaagatgaagattcgcccgtacccggactgacccatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgccccaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1776 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPFSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1777 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcactgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatatcgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagcaggtaagcatcgtgagggtgtagctgcactttccggaggtcagcagttggctttagagccttccgacttagctcgcaaaaaacgcaagttcgataagaactaa

SEQ ID NO: 1778 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYISKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRKFDKN

SEQ ID NO: 1779 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagtcggtaagcatcgtgagggtgtagctgcactttccggaggtcagcagttggctttagagccttccgacttagctcgcaaaaaacgcaagttcgataagaactaa

SEQ ID NO: 1780 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRVGKHREGVAALSGGQQLALEPSDLARKKRKFDKN

SEQ ID NO: 1781 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtagtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1782 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGSKVPVAPNYVVSQSPRHVVLRNYEGVITTYTEPEDYHEECDCEDCRAGKHREGVAALSGGQQLALEPSDLARKKRKFDKN

SEQ ID NO: 1783 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccatttagtgaagatgaagattcgcccgtacccggactgacccatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacaaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccaaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1784 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPFSEDEDSPVPGLTHRYPDRVLFLITDKCSMYCRHCTRRRFAGQRDASSPSERIDRCIDYIANTPTVRDVLLSGGDALLVSDKRLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRKFDKN

SEQ ID NO: 1785 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1786 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1787 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctctctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagctggctttagagccttccgacttagctcgcaaaaaacgcaagttcgataagaactaa

SEQ ID NO: 1788 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLSQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1789 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1790 - protein, 416 aa, Artificial Sequence; identical to SEQ ID NO: 1294
  Description of Artificial Sequence: Synthetic Construct

SEQ ID NO: 1791 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcgcgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1792 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1793 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgtgcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaggttcgataagaactaa

SEQ ID NO: 1794 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSVRIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRRFDKN

SEQ ID NO: 1795 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1796 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQLALEPSDLARKKRKFDKN

SEQ ID NO: 1797 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaagaaacgcaagttcgataagaactaa

SEQ ID NO: 1798 - protein, 416 aa, Artificial Sequence; identical to SEQ ID NO: 1796
  Description of Artificial Sequence: Synthetic Construct

SEQ ID NO: 1799 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatgttgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1800 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYMLKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQLALEPSDLARKKRKFDKN

SEQ ID NO: 1801 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgagggtgttaccacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1802 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVTTTYTEPENYHEECDCEDCRAGKHREGVAALSGGQQLALEPSDLARKKRKFDKN

SEQ ID NO: 1803 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtaccccatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1804 - protein, 416 aa, Artificial Sequence; identical to SEQ ID NO: 1762
  Description of Artificial Sequence: Synthetic Construct

SEQ ID NO: 1805 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtttgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtagccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1806 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGSQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1807 - DNA, 1251 bp, Artificial Sequence
  Description of Artificial Sequence: Synthetic mutant of Pgaam2 with AAM activity
  CDS (1)..(1251)
atggctgaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1808 - protein, 416 aa, Artificial Sequence; identical to SEQ ID NO: 1294
  Description of Artificial Sequence: Synthetic Construct

SEQ ID NO: 1809 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgagggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1810 - protein, 416 aa, Artificial Sequence; identical to SEQ ID NO: 1796
  Description of Artificial Sequence: Synthetic Construct

SEQ ID NO: 1811 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1812 - protein, 416 aa, Artificial Sequence; identical to SEQ ID NO: 1282
  Description of Artificial Sequence: Synthetic Construct

SEQ ID NO: 1813 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1814 - protein, 416 aa, Artificial Sequence; identical to SEQ ID NO: 1762
  Description of Artificial Sequence: Synthetic Construct

SEQ ID NO: 1815 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1816 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEITENLRGHTSGYAVPTFVVHAPGGGGKIPVAPNYVVSQSPRHVVLRNYEGVITTYTEPENYHEECDCEDCRAGKHREGVAALSGGQQLALEPSDLARKKRKFDKN

SEQ ID NO: 1817 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1818 - protein, 416 aa, Artificial Sequence; identical to SEQ ID NO: 1762
  Description of Artificial Sequence: Synthetic Construct

SEQ ID NO: 1819 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1820 - protein, 416 aa, Artificial Sequence; identical to SEQ ID NO: 1796
  Description of Artificial Sequence: Synthetic Construct

SEQ ID NO: 1821 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctgtggcgccgaactatgttgtatctcagtccccacgacatgtggttcttcgcaattatgagggtgttaccacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1822 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIESLRGHTSGYAVPTFVVHAPGGGGKIPVAPNYVVSQSPRHVVLRNYEGVTTTYTEPENYHEECDCEDCRAGKHREGVAALSGGQQLALEPSDLARKKRKFDKN

SEQ ID NO: 1823 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaaggatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1824 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKGLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1825 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccagttagtgaagatgaagattcgcccgtacccggactgccccatcgttatccggatcgtgtattgttccttatcacggacaaatgttcgatgtacagtcgtcattgtactagccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttaccacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1826 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPVSEDEDSPVPGLPHRYPDRVLFLITDKCSMYSRHCTSRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVTTTYTEPENYHEECDCEDCRAGKHREGVAALSGGQQLALEPSDLARKKRKFDKN

SEQ ID NO: 1827 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagcccgcaaaaaacgcaagttcgataagaactaa

SEQ ID NO: 1828 - protein, 416 aa, Artificial Sequence; identical to SEQ ID NO: 1752
  Description of Artificial Sequence: Synthetic Construct

SEQ ID NO: 1829 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaggtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1830 - protein, 416 aa, Artificial Sequence
  Description of Artificial Sequence: Synthetic Construct
MAESRRKYYFPDVTDEQWYDWHWQVINRIKTLDQLERYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRKFDKN

SEQ ID NO: 1831 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttaccacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1832 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRAGKHREGVAALSGGQQLALEPSDLARKKRKFDKN

SEQ ID NO: 1833 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1834 - protein, 416 aa, Artificial Sequence; identical to SEQ ID NO: 1282
  Description of Artificial Sequence: Synthetic Construct

SEQ ID NO: 1835 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctctattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1836 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPLLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRKFDKN

SEQ ID NO: 1837 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgagggtgttaccacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1838 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGVPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRAGKHREGVAALSGGQQLALEPSDLARKKRKFDKN

SEQ ID NO: 1839 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1840 - protein, 416 aa, Artificial Sequence; identical to SEQ ID NO: 1282
  Description of Artificial Sequence: Synthetic Construct

SEQ ID NO: 1841 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtactccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1842 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGTPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPENYHEECDCEDCRAGKHREGVAALSGGQQLALEPSDLARKKRKFDKN

SEQ ID NO: 1843 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1844 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1845 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1846 - protein, 416 aa, Artificial Sequence; identical to SEQ ID NO: 1844
  Description of Artificial Sequence: Synthetic Construct

SEQ ID NO: 1847 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccagtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccccgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1848 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1849 - DNA, 1251 bp, Artificial Sequence
  Description of Artificial Sequence: Synthetic mutant of Pgaam2 with AAM activity
  CDS (1)..(1251)
atggcagaaagtcgtagaaagtattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagtcggtaagcatcgtgagggtgtagctgcactttccggaggtcagcagttggctttagagccttccgacttagctcgcaaaaaacgcaagttcgataagaactaa

SEQ ID NO: 1850 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRVGKHREGVAALSGGQQLALEPSDLARKKRKFDKN

SEQ ID NO: 1851 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggagtagctgcactttccggaggtcagcagttggctttagagccttccgacttagctcgcaaaaaacgcaagttcgataagaactaa

SEQ ID NO: 1852 - protein, 416 aa, Artificial Sequence; identical to SEQ ID NO: 1848
  Description of Artificial Sequence: Synthetic Construct

SEQ ID NO: 1853 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1854 - protein, 416 aa, Artificial Sequence; identical to SEQ ID NO: 1848
  Description of Artificial Sequence: Synthetic Construct

SEQ ID NO: 1855 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacggtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1856 - protein, 416 aa, Artificial Sequence; identical to SEQ ID NO: 1844
  Description of Artificial Sequence: Synthetic Construct

SEQ ID NO: 1857 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagtcggtaagcatcgtgagggtgtagctgcactttccggaggtcagcagttggctttagagccttccgacttagctcgcaaaaaacgcaagttcgataagaactaa

SEQ ID NO: 1858 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRVGKHREGVAALSGGQQLALEPSDLARKKRKFDKN

SEQ ID NO: 1859 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgagcactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1860 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLSTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1861 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtggggactgtcgagccggtaagcatcgtgagggtgtagctgcactttccggaggtcagcagttggctttagagccttccgacttagctcgcaaaaaacgcaagttcgataagaactaa

SEQ ID NO: 1862 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCGDCRAGKHREGVAALSGGQQLALEPSDLARKKRKFDKN

SEQ ID NO: 1863 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaacacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1864 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRKFDKN

SEQ ID NO: 1865 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagtcggtaagcatcgtgagggtgtagctgcactttccggaggtcagcagttggctttagagccttccgacttagctcgcaaaaaacgcaagttcgataagaactaa

SEQ ID NO: 1866 - protein, 416 aa, Artificial Sequence; identical to SEQ ID NO: 1780
  Description of Artificial Sequence: Synthetic Construct

SEQ ID NO: 1867 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1868 - protein, 416 aa, Artificial Sequence; identical to SEQ ID NO: 1844
  Description of Artificial Sequence: Synthetic Construct

SEQ ID NO: 1869 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1870 - protein, 416 aa, Artificial Sequence; identical to SEQ ID NO: 1282
  Description of Artificial Sequence: Synthetic Construct

SEQ ID NO: 1871 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcggcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1872 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVGDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1873 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagtcggtaagcatcgtgagggtgtagctgcactttccggaggtcagcagttggctttagagccttccgacttagctcgcaaaaaacgcaagttcgataagaactaa

SEQ ID NO: 1874 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRVGKHREGVAALSGGQQLALEPSDLARKKRKFDKN

SEQ ID NO: 1875 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttaccacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1876 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVTTTYTEPEDYHEECDCEDCRAGKHREGVAALSGGQQLALEPSDLARKKRKFDKN

SEQ ID NO: 1877 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttggataagaactaa

SEQ ID NO: 1878 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKLDKN

SEQ ID NO: 1879 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtatccggactgacccatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaaatggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1880 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVSGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQMVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1881 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagtcggtaagcatcgtgagggtgtagctgcactttccggaggtcagcagttggctttagagccttccgacttagctcgcaaaaaacgcaagttcgataagaactaa

SEQ ID NO: 1882 - protein, 416 aa, Artificial Sequence; identical to SEQ ID NO: 1780
  Description of Artificial Sequence: Synthetic Construct

SEQ ID NO: 1883 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgtggactgtcgagccggtaagcatcgtgagggtgtagctgcactttccggaggtcagcagttggctttagagccttccgacttagctcgcaaaaaacgcaagttcgataagaactaa

SEQ ID NO: 1884 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCVDCRAGKHREGVAALSGGQQLALEPSDLARKKRKFDKN

SEQ ID NO: 1885 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1886 - protein, 416 aa, Artificial Sequence; identical to SEQ ID NO: 1844
  Description of Artificial Sequence: Synthetic Construct

SEQ ID NO: 1887 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1888 - protein, 416 aa, Artificial Sequence; identical to SEQ ID NO: 1752
  Description of Artificial Sequence: Synthetic Construct

SEQ ID NO: 1889 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgtctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1890 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITSQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1891 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1892 - protein, 416 aa, Artificial Sequence; identical to SEQ ID NO: 1848
  Description of Artificial Sequence: Synthetic Construct

SEQ ID NO: 1893 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1894 - protein, 416 aa, Artificial Sequence; identical to SEQ ID NO: 1786
  Description of Artificial Sequence: Synthetic Construct

SEQ ID NO: 1895 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattgtttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagtcggtaagcatcgtgagggtgtagctgcactttccggaggtcagcagttggctttagagccttccgacttagctcgcaaaaaacgcaagttcgataagaactaa

SEQ ID NO: 1896 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYCLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRVGKHREGVAALSGGQQLALEPSDLARKKRKFDKN

SEQ ID NO: 1897 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacgacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1898 - protein, 416 aa, Artificial Sequence; identical to SEQ ID NO: 1864
  Description of Artificial Sequence: Synthetic Construct

SEQ ID NO: 1899 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1900 - protein, 416 aa, Artificial Sequence; identical to SEQ ID NO: 1844
  Description of Artificial Sequence: Synthetic Construct

SEQ ID NO: 1901 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggcagacccacttagtgaagatgaagattcgcccgtacccggactgacccatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1902 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMADPLSEDEDSPVPGLTHRYPDRVLFLITDKCSMYCRHCTRRRFAGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1903 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctgtcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggccccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1904 - protein, 416 aa, Artificial Sequence; identical to SEQ ID NO: 1848
  Description of Artificial Sequence: Synthetic Construct

SEQ ID NO: 1905 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1906 - protein, 416 aa, Artificial Sequence; identical to SEQ ID NO: 1848
  Description of Artificial Sequence: Synthetic Construct

SEQ ID NO: 1907 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgcgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1908 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHAMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1909 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggccccgaactatgttgtatctcagtccccacgacatgtggttcttcgcaattatgaaggtgatatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1910 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGDITTYTEPEDYHEECDCEDCRAGKHREGVAALSGGQQLALEPSDLARKKRKFDKN

SEQ ID NO: 1911 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1912 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1913 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1914 - protein, 416 aa, Artificial Sequence; identical to SEQ ID NO: 1786
  Description of Artificial Sequence: Synthetic Construct

SEQ ID NO: 1915 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1916 - protein, 416 aa, Artificial Sequence; identical to SEQ ID NO: 1864
  Description of Artificial Sequence: Synthetic Construct

SEQ ID NO: 1917 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaagaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1918 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQRDASSPSERIDRCIDYIANTPTVRDVLLSGGDALLVSDERLEYILKRLREVPHVEIVRIGSRTPVVLPQRITPQLVDMLKEYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQLALEPSDLARKKRKFDKN

SEQ ID NO: 1919 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctggagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1920 - protein, 416 aa, Artificial Sequence
  Description of Artificial Sequence: Synthetic Construct
MAESRRKYYFPDVTDEQWYDWHWQVINRIKTLDQLEKYVTLTAGEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1921 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1922 - protein, 416 aa, Artificial Sequence; identical to SEQ ID NO: 1282
  Description of Artificial Sequence: Synthetic Construct

SEQ ID NO: 1923 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtgcgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttatcacaacctatacggagccggaggactatcatgaggagtgcgattgtgaggactgtcgagtcggtaagcatcgtgagggtgtagctgcactttccggaggtcagcagttggctttagagccttccgacttagctcgcaaaaaacgcaagttcgataagaactaa

SEQ ID NO: 1924 - protein, 416 aa, Artificial Sequence
  Description of Artificial Sequence: Synthetic Construct
MAESRRKYYFPDVTDEQWYDWHWQVINRIKTLDQLEKCVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRVGKHREGVAALSGGQQLALEPSDLARKKRKFDKN

SEQ ID NO: 1925 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1926 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRKFDKN

SEQ ID NO: 1927 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcaataagaactaa

SEQ ID NO: 1928 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFNKN

SEQ ID NO: 1929 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaattgctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1930 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRIAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1931 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1932 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRKFDKN

SEQ ID NO: 1933 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggagaattatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1934 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPENYHEECDCEDCRAGKHREGVAALSGGQQLALEPSDLARKKRKFDKN

SEQ ID NO: 1935 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1936 - protein, 416 aa, Artificial Sequence; identical to SEQ ID NO: 1844
  Description of Artificial Sequence: Synthetic Construct

SEQ ID NO: 1937 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1938 - protein, 416 aa, Artificial Sequence; identical to SEQ ID NO: 1848
  Description of Artificial Sequence: Synthetic Construct

SEQ ID NO: 1939 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagtcggtaagcatcgtgagggtgtagctgcactttccggaggtcagcagttggctttagagccttccgacttagctcgcaaaaaacgcaagtttgataagaactaa

SEQ ID NO: 1940 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRVGKHREGVAALSGGQQLALEPSDLARKKRKFDKN

SEQ ID NO: 1941 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatggaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1942 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYGGVITTYTEPEDYHEECDCEDCRAGKHREGVAALSGGQQLALEPSDLARKKRKFDKN

SEQ ID NO: 1943 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcccacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1944 - protein, 416 aa, Artificial Sequence; identical to SEQ ID NO: 1786
  Description of Artificial Sequence: Synthetic Construct

SEQ ID NO: 1945 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctaccttcgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1946 - protein, 416 aa, Artificial Sequence; identical to SEQ ID NO: 1786
  Description of Artificial Sequence: Synthetic Construct

SEQ ID NO: 1947 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgtcatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1948 - protein, 416 aa, Artificial Sequence; identical to SEQ ID NO: 1786
  Description of Artificial Sequence: Synthetic Construct

SEQ ID NO: 1949 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttactgcgtggaatcaatgattgtacacatgtgctgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1950 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVLKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1951 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1952 - protein, 416 aa, Artificial Sequence; identical to SEQ ID NO: 1848
  Description of Artificial Sequence: Synthetic Construct

SEQ ID NO: 1953 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcacttcccggaggtcagcagttggctttagagccttccgacttagctcgcaaaaaacgcaagttcgataagaactaa

SEQ ID NO: 1954 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALPGGQQLALEPSDLARKKRKFDKN

SEQ ID NO: 1955 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagtcggtaagcatcgtgagggtgtagctgcactttccggaggtcagcagttggctttagagccttccgacttagctcgcaaaaaacgcaagttcgataagaactaa

SEQ ID NO: 1956 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRVGKHREGVAALSGGQQLALEPSDLARKKRKFDKN

SEQ ID NO: 1957 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttaatgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1958 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLNEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1959 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttgttgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1960 - protein, 416 aa, Artificial Sequence; identical to SEQ ID NO: 1848
  Description of Artificial Sequence: Synthetic Construct

SEQ ID NO: 1961 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccactgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1962 - protein, 416 aa, Artificial Sequence
  Description of Artificial Sequence: Synthetic Construct
MAESRRKYYFPDVTDEQWYDWHWQVINRIKTLDQLEKYVTLTTEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1963 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgactgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1964 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLMDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1965 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagaccctcttagtgaagatgaagattcgcccgtacccggactgactcatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctgcctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1966 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPAFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1967 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1968 - protein, 416 aa, Artificial Sequence; identical to SEQ ID NO: 1844
  Description of Artificial Sequence: Synthetic Construct

SEQ ID NO: 1969 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccagagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcacaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcatcgtgagggtgtagctgcactttccggaggtcagcagttggctttagagccttccgacttagctcgcaaaaaacgcaagttcgataagaactaa

SEQ ID NO: 1970 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPRVLRMAITPYYLSLIDPENPNCPIRKQAIPTKQELVRAPEDMVDPLSEDEDSPVPGLTHRYPDRVLFLITDKCSMYCRHCTRRRFTGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHREGVAALSGGQQLALEPSDLARKKRKFDKN

SEQ ID NO: 1971 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtactgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagagcgataagaactaa

SEQ ID NO: 1972 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRADKHKEGVAALSGGQQLALEPPDLARKKRKSDKN

SEQ ID NO: 1973 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgcgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttaccacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 1974 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPITPNYVVSQSPRHVVLRNYEGVTTTYTEPEDYHEECDCEDCRADKHKEGVAALSGGQQLALEPPDLARKKRKFDKN

SEQ ID NO: 1975 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgctgttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 1976 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRADKHKEGVAALSGGQQLALEPPDLARKKRKFDKN

SEQ ID NO: 1977 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgagggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 1978 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVILRNYEGVITTYTEPEDYHEECDCEDCRADKHKEGVAALSGGQQLALEPPDLARKKRKFDKN

SEQ ID NO: 1979 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgagggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 1980 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 1981 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttgaaatacatattgaagcgtctgcgcgaagtacctcatgtggagattgttcgtataggaacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 1982 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLKYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 1983 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgagaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 1984 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 1985 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccatacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagagcgataagaactaa

SEQ ID NO: 1986 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPIPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKSDKN

SEQ ID NO: 1987 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgagggtgttaccacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 1988 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVTTTYTEPEDYHEECDCEDCRADKHKEGVAALSGGQQLALEPPDLARKKRKFDKN

SEQ ID NO: 1989 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgagaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttactgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaaccaa

SEQ ID NO: 1990 - protein, 417 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVILRNYEGVITTYTEPEDYHEECDCEDCRADKHKEGVAALSGGQQLALEPPDLARKKRKFDKNQ

SEQ ID NO: 1991 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaggaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgagggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 1992 - protein, 416 aa, Artificial Sequence; identical to SEQ ID NO: 1980
  Description of Artificial Sequence: Synthetic Construct

SEQ ID NO: 1993 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 1994 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 1995 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcgaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttaccacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 1996 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLEKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVTTTYTEPEDYHEECDCEDCRADKHKEGVAALSGGQQLALEPPDLARKKRKFDKN

SEQ ID NO: 1997 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgagaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcgcgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagagcgataagaactaa

SEQ ID NO: 1998 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRAPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKSDKN

SEQ ID NO: 1999 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgagggtgttatcacaacctatacggagccggaggactatcatgaggagtgcgattgtgaggactgccgagccgacaagcataaagagggtgtggctgcactttccggaggtcagcagttggctttagagcctcccgacctagctcgcaaaaaacgcaagttcgataagaactaa

SEQ ID NO: 2000 - protein, 416 aa, Artificial Sequence; identical to SEQ ID NO: 1978
  Description of Artificial Sequence: Synthetic Construct

SEQ ID NO: 2001 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2002 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2003 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgctttggatacatattgaagcgtctgcgggaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccatactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2004 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERFGYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2005 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctaccttcgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2006 - protein, 416 aa, Artificial Sequence; identical to SEQ ID NO: 1980
  Description of Artificial Sequence: Synthetic Construct

SEQ ID NO: 2007 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2008 - protein, 416 aa, Artificial Sequence; identical to SEQ ID NO: 2002
  Description of Artificial Sequence: Synthetic Construct

SEQ ID NO: 2009 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttaccacaacctatacggagccggaggactatcatgaggagtgcgattgtgaggactgccgagccgacaagcataaagagggtgtggctgcactttccggaggtcagcagttggctttagagccttccgacttagctcgcaaaaaacgcaagttcgataagaactaa

SEQ ID NO: 2010 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVTTTYTEPEDYHEECDCEDCRADKHKEGVAALSGGQQLALEPSDLARKKRKFDKN

SEQ ID NO: 2011 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2012 - protein, 416 aa, Artificial Sequence; identical to SEQ ID NO: 1978
  Description of Artificial Sequence: Synthetic Construct

SEQ ID NO: 2013 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaaccaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2014 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGTNDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2015 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacgagaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgagggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2016 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPKCPIRKQAIPTQRELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2017 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagagcgataagaactaa

SEQ ID NO: 2018 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKSDKN

SEQ ID NO: 2019 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcacccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2020 - protein, 416 aa, Artificial Sequence; identical to SEQ ID NO: 1980
  Description of Artificial Sequence: Synthetic Construct

SEQ ID NO: 2021 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcgtgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagagcgataagaactaa

SEQ ID NO: 2022 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKSDKN

SEQ ID NO: 2023 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagagcgataagaactaa

SEQ ID NO: 2024 - protein, 416 aa, Artificial Sequence; identical to SEQ ID NO: 2022
  Description of Artificial Sequence: Synthetic Construct

SEQ ID NO: 2025 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgagggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2026 - protein, 416 aa, Artificial Sequence; identical to SEQ ID NO: 1980
  Description of Artificial Sequence: Synthetic Construct

SEQ ID NO: 2027 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggcctatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagagcgataagaactaa

SEQ ID NO: 2028 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMAYAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKSDKN

SEQ ID NO: 2029 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2030 - protein, 416 aa, Artificial Sequence; identical to SEQ ID NO: 1980
  Description of Artificial Sequence: Synthetic Construct

SEQ ID NO: 2031 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagagcgataagaactaa

SEQ ID NO: 2032 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLRGVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKSDKN

SEQ ID NO: 2033 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgagattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2034 - protein, 416 aa, Artificial Sequence; identical to SEQ ID NO: 1980
  Description of Artificial Sequence: Synthetic Construct

SEQ ID NO: 2035 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggtggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2036 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVVACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRADKHKEGVAALSGGQQLALEPPDLARKKRKFDKN

SEQ ID NO: 2037 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttctgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2038 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVILRNYEGVITTYTEPEDYHEECDCEDCRADKHKEGVAALSGGQQLALEPPDLARKKRKFDKN

SEQ ID NO: 2039 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2040 - protein, 416 aa, Artificial Sequence; identical to SEQ ID NO: 1980
  Description of Artificial Sequence: Synthetic Construct

SEQ ID NO: 2041 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatactgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgcgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagagcgataagaactaa

SEQ ID NO: 2042 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKSDKN

SEQ ID NO: 2043 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2044 - protein, 416 aa, Artificial Sequence; identical to SEQ ID NO: 1978
  Description of Artificial Sequence: Synthetic Construct

SEQ ID NO: 2045 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2046 - protein, 416 aa, Artificial Sequence; identical to SEQ ID NO: 1980
  Description of Artificial Sequence: Synthetic Construct

SEQ ID NO: 2047 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2048 - protein, 416 aa, Artificial Sequence; identical to SEQ ID NO: 1976
  Description of Artificial Sequence: Synthetic Construct

SEQ ID NO: 2049 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgagaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2050 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2051 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2052 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2053 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2054 - protein, 416 aa, Artificial Sequence; identical to SEQ ID NO: 1978
  Description of Artificial Sequence: Synthetic Construct

SEQ ID NO: 2055 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2056 - protein, 416 aa, Artificial Sequence; identical to SEQ ID NO: 1980
  Description of Artificial Sequence: Synthetic Construct

SEQ ID NO: 2057 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtgatacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2058 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVIHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2059 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgatccgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgttaagaactaa

SEQ ID NO: 2060 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVILRNYEGVITTYTEPEDYHEECDCEDCRADKHKEGVAALSGGQQLALEPPDLARKKRKFVKN

SEQ ID NO: 2061 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacacgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2062 - protein, 416 aa, Artificial Sequence; identical to SEQ ID NO: 1980
  Description of Artificial Sequence: Synthetic Construct

SEQ ID NO: 2063 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggtagccgtacgccggtagtcctccctcagcgtatatcgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagagcgataagaactaa

SEQ ID NO: 2064 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRISPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKSDKN

SEQ ID NO: 2065 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgagaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2066 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2067 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagtgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgcgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2068 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKCLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRARPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2069 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtactccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacgtgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2070 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGTPLGNQTVLLRGINDCTHVMKRLVHLLVKIRVRPYYIYACDLSLGIGHFRTPVSKGIEIIENLRGHTSGYAVPTFVVRAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2071 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttaccacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2072 - protein, 416 aa, Artificial Sequence; identical to SEQ ID NO: 1988
  Description of Artificial Sequence: Synthetic Construct

SEQ ID NO: 2073 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcacggacacacctcgggctatgcagttcctacctttgtggtacatgctccggggggtggtggtaagatacctgtaacgccgaactatgttgtatctcagtccccacgacatgtggttcttcgcaattatgaaggtgttaccacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2074 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLHGHTSGYAVPTFVVHAPGGGGKIPVTPNYVVSQSPRHVVLRNYEGVTTTYTEPEDYHEECDCEDCRADKHKEGVAALSGGQQLALEPPDLARKKRKFDKN

SEQ ID NO: 2075 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgcactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2076 - protein, 416 aa, Artificial Sequence; identical to SEQ ID NO: 1980
  Description of Artificial Sequence: Synthetic Construct

SEQ ID NO: 2077 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgagaactggtacgtgctcctgaagatatggtagacccacttagtgaagatgaagattcgcccgtacccggactgactcatcgttatccggatcgtgtattgttccttatcacagacaaatgttcgatgtactgtcgtcattgtactcgccgtcgcttcgcaggacagaaagatgcttcttctccttctgagcgcatcgatcgatgcattgagtatatagccaatacaccgacagtccgcgatggtttgctatcgggaggcgatgccctccttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2078 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDGLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2079 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgccaccgatgagcaatggtacgactggcattggcaggtcatcaatcgaattaagacgctcgaccagctggagaagtacgttatactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatgtggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaagcggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcggttgtgaggactgccgagccgacaagcataaagagggtgtggctgcactttccggaggtcagcagttggctttagagcctcccgacttagctcgcaaaaaacgcaagttcgataagaactaa

SEQ ID NO: 2080 - protein, 416 aa, Artificial Sequence
  Description of Artificial Sequence: Synthetic Construct
MAESRRKYYFPDATDEQWYDWHWQVINRIKTLDQLEKYVILTAEEEEGVKESPKVLRMAITPYYLSLIDPENPNCPIRKQAIPTQQELVRAPEDVVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQAVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECGCEDCRADKHKEGVAALSGGQQLALEPPDLARKKRKFDKN

SEQ ID NO: 2081 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgctgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtcctcacgacatgtgattcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2082 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRCRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSSRHVILRNYEGVITTYTEPEDYHEECDCEDCRADKHKEGVAALSGGQQLALEPPDLARKKRKFDKN

SEQ ID NO: 2083 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtagaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccccccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtgattcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2084 - protein, 416 aa, Artificial Sequence
  Description of Artificial Sequence: Synthetic Construct
MAESRRKYYFPDVTDEQWYDWHWQVINRIKTLDQLEKYVTLTAEEEEGVEESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDAPLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVILRNYEGVITTYTEPEDYHEECDCEDCRADKHKEGVAALSGGQQLALEPPDLARKKRKFDKN

SEQ ID NO: 2085 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgagaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttactggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2086 - protein, 416 aa, Artificial Sequence; identical to SEQ ID NO: 1984
  Description of Artificial Sequence: Synthetic Construct

SEQ ID NO: 2087 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacttatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgcccttcttgtcagcgacgaacgcttggaatacatattgaagcgtctgcgcgaagtacctcatgtggagattgttcgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagagcgataagaactaa

SEQ ID NO: 2088 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTYRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKSDKN

SEQ ID NO: 2089 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactctacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcttgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgagggtgttatcacaacctatacggagccggaggactatcatgaggagtgcgattgtgaggactgccgagccgacaagcataaagagggtgtggctgcactttccggaggtcagcagctggctttagagcctcccgacttagctcgcaaaaaacgcaagttcgataagaactaa

SEQ ID NO: 2090 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTLQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPLVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2091 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgagaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatctggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcaatccccacgacatgtggttcttcgcaattatgagggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2092 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHLVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2093 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtgctccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgagggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagctcgataagaactaa

SEQ ID NO: 2094 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKLDKN

SEQ ID NO: 2095 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2096 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2097 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtccgtataggaagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccagggggtggtggtaagatacctatagcgccgaactatgttgtatctcagtccccacgacatgtgattcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagagcgataagaactaa

SEQ ID NO: 2098 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPIAPNYVVSQSPRHVILRNYEGVITTYTEPEDYHEECDCEDCRADKHKEGVAALSGGQQLALEPPDLARKKRKSDKN

SEQ ID NO: 2099 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgagggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2100 - protein, 416 aa, Artificial Sequence; identical to SEQ ID NO: 2096
  Description of Artificial Sequence: Synthetic Construct

SEQ ID NO: 2101 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcacaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagttcgataagaactaa

SEQ ID NO: 2102 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPITPNYVVSQSPRHVVLRNYEGVITTYTEPEDYHEECDCEDCRADKHKEGVAALSGGQQLALEPPDLARKKRKFDKN

SEQ ID NO: 2103 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaagagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtgattcttcgcaattatgaaggtgttatcacaacctatacggagccggaggactatcatgaggagtgcgattgtgaggactgccgagccgacaagcataaagagggtgtggctgcactttccggaggtcagcagttggctttagagcctcccgacttagctcgcaaaaaacgcaagctcgataagaactaa

SEQ ID NO: 2104 - protein, 416 aa, Artificial Sequence
  Description of Artificial Sequence: Synthetic Construct
MAESRRKYYFPDVTDEQWYDWHWQVINRIKTLDQLEKYVTLTAEEEEGVRESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPITPNYVVSQSPRHVILRNYEGVITTYTEPEDYHEECDCEDCRADKHKEGVAALSGGQQLALEPPDLARKKRKLDKN

SEQ ID NO: 2105 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtgattcttcgcaattatgaaggtgttaccacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagttcgataagaactaa

SEQ ID NO: 2106 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVILRNYEGVTTTYTEPEDYHEECDCEDCRAGKHKEGVAALSGGQQLALEPSDLARKKRKFDKN

SEQ ID NO: 2107 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagctcgataagaactaa

SEQ ID NO: 2108 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKLDKN

SEQ ID NO: 2109 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaaccaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2110 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGTNDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKFDKN

SEQ ID NO: 2111 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2112 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKFDKN

SEQ ID NO: 2113 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctgcactttccggaggtcagcagttggctttagagccttccgacttagctcgcaaaaaacgcaagagcgataagaactaa

SEQ ID NO: 2114 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLALEPSDLARKKRKSDKN

SEQ ID NO: 2115 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctacactttccggaggtcagcagttggctttagagccttccgacttagctcgcaaaaaacgcaagagcgataagaactaa

SEQ ID NO: 2116 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVATLSGGQQLALEPSDLARKKRKSDKN

SEQ ID NO: 2117 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagttcgataagaactaa

SEQ ID NO: 2118 - protein, 416 aa, Artificial Sequence; identical to SEQ ID NO: 1284
  Description of Artificial Sequence: Synthetic Construct

SEQ ID NO: 2119 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctacactttccggaggtcagcagttggctttagagcctcccgacttagctcgcaaaaaacgcaagttcgataagaactaa

SEQ ID NO: 2120 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRAGKHKEGVATLSGGQQLALEPPDLARKKRKFDKN

SEQ ID NO: 2121 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctgcactttccggaggtcagcagttggctttagagccttccgacttagctcgcaaaaaacgcaagagcgataagaactaa

SEQ ID NO: 2122 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKSDKN

SEQ ID NO: 2123 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactacgttgtatctcagtccccacgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2124 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDYHEECDCEDCRAGKHKEGVAALSGGQQLALEPSDLARKKRKFDKN

SEQ ID NO: 2125 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgctccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2126 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLLLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLALEPSDLARKKRKFDKN

SEQ ID NO: 2127 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggcctatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2128 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMAYAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVTTTYTEPEDYHEECDCEDCRAGKHKEGVAALSGGQQLALEPSDLARKKRKFDKN

SEQ ID NO: 2129 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacgtattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2130 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYVLKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKFDKN

SEQ ID NO: 2131 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2132 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLALEPSDLARKKRKFDKN

SEQ ID NO: 2133 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctacactttccggaggtcagcagttggctttagagcctcccgacttagctcgcaaaaaacgcaagagcgataagaactaa

SEQ ID NO: 2134 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVATLSGGQQLALEPPDLARKKRKSDKN

SEQ ID NO: 2135 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagactcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2136 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRAGKHKEGVAALSGGQQLALEPSDLARKKRKFDKN

SEQ ID NO: 2137 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcgatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgtcggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctgcactttccggaggtcagcagttggctttagagccttccgacttagctcgcaaaaaacgcaagagcgataagaactaa

SEQ ID NO: 2138 - protein, 416 aa, Artificial Sequence
  Description of Artificial Sequence: Synthetic Construct
MAESRRKYYFPDVTDERWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANVGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKSDKN

SEQ ID NO: 2139 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtgattcttcgcaattatgagggtgttatcacaacctatacggagccggaggactatcatgaggagtgcgattgtgaggactgtcgagccgacaagcataaagagggtgtagctgcactttccggaggtcagcagttggctttagagccttccgacttagctcgcaaaaaacgcaagttcgataagaactaa

SEQ ID NO: 2140 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVILRNYEGVITTYTEPEDYHEECDCEDCRADKHKEGVAALSGGQQLALEPSDLARKKRKFDKN

SEQ ID NO: 2141 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggtacttcgcaattatgagggtgttaccacaacctatacggagccggaggactatcatgaggagtgcgattgtgaggactgtcgagccgacaagcataaagagggcgtggctgcactttccggaggtcagcagttggctttagagccttccgacttagctcgcaaaaaacgcaagttcgataagaactaa

SEQ ID NO: 2142 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDYHEECDCEDCRADKHKEGVAALSGGQQLALEPSDLARKKRKFDKN

SEQ ID NO: 2143 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2144 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVILRNYEGVITTYTEPEDYHEECDCEDCRAGKHKEGVAALSGGQQLALEPSDLARKKRKFDKN

SEQ ID NO: 2145 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaggaagaagagggagtaaaagaatcgcccaaagtactccgaatggctatcacaccttattatttgagtttgatagaccccgagaatcctagttgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttaccacaacctatacggagccggaggactatcatgaggagtgcgattgtgaggactgtcgagccgacaagcataaagagggtgtagctgcactttccggaggtcagcagttggctttagagccttccgacttagctcgcaaaaaacgcaagttcgataagaactaa

SEQ ID NO: 2146 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPSCPIRKQAIPTRQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVTTTYTEPEDYHEECDCEDCRADKHKEGVAALSGGQQLALEPSDLARKKRKFDKN

SEQ ID NO: 2147 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttatcacaacctatacggagccggaggactatcatgaggagtgcgattgtgaggactgtcgagccggcaagcataaagagggtgtagctgcactttccggaggtcagcagttggctttagagccttccgacttagctcgcaaaaaacgcaagatcgataagaactaa

SEQ ID NO: 2148 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLALEPSDLARKKRKIDKN

SEQ ID NO: 2149 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtatagggacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2150 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVTTTYTEPEDYHEECDCEDCRAGKHKEGVAALSGGQQLALEPSDLARKKRKSDKN

SEQ ID NO: 2151 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2152 - protein, 416 aa, Artificial Sequence; identical to SEQ ID NO: 910
  Description of Artificial Sequence: Synthetic Construct

SEQ ID NO: 2153 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgtagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagactcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 2154 - protein, 416 aa, Artificial Sequence
  Description of Artificial Sequence: Synthetic Construct
MAESRRKYYFPDVTDEQWYDWHWQVINRIKTLDQLEKYVTLTAVEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKLDKN

SEQ ID NO: 2155 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctctggctatgcagttcctacctttgtggtacatgctccggggggtggtggtaaggtccctttggcgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2156 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKSDKN

SEQ ID NO: 2157 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2158 - protein, 416 aa, Artificial Sequence; identical to SEQ ID NO: 2112
  Description of Artificial Sequence: Synthetic Construct

SEQ ID NO: 2159 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgtatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctgcactttccggaggtcagcagttggctttagagcctcccgacttagctcgcaaaaaacgcaagttcgataagaactga

SEQ ID NO: 2160 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRAGKHKEGVAALSGGQQLALEPPDLARKKRKFDKN

SEQ ID NO: 2161 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagttcgataagaactaa

SEQ ID NO: 2162 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKFDKN

SEQ ID NO: 2163 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtatcccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 2164 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHEECDCEDCRAGKHKEGVAALSGGQQLALEPSDLARKKRKLDKN

SEQ ID NO: 2165 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgagggtgttatcacaacctatacggagccggaggactatcatgaggagtgcgattgtgaggactgtcgagccggtaagcataaagagggcgtggctgcactttccggaggtcagcagttggctttagagcctcccgacttagctcgcaaaaaacgcaagttcgataagaactaa

SEQ ID NO: 2166 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHEECDCEDCRAGKHKEGVAALSGGQQLALEPPDLARKKRKFDKN

SEQ ID NO: 2167 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgacctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2168 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKSDKN

SEQ ID NO: 2169 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2170 - protein, 416 aa, Artificial Sequence; identical to SEQ ID NO: 2136
  Description of Artificial Sequence: Synthetic Construct

SEQ ID NO: 2171 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcctcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 2172 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRLAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKLDKN

SEQ ID NO: 2173 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2174 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHEECDCEDCRAGKHKEGVAALSGGQQLALEPSDLARKKRKFDKN

SEQ ID NO: 2175 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaagcaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacacttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattgtcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2176 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDEHLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIVENLRGHTSGYAVPTFVVHAPGGGGKVPLAPNYVVSQSPRHVVLRNYEGVTTTYTEPEDYHEECDCEDCRAGKHKEGVAALSGGQQLALEPSDLARKKRKFDKN

SEQ ID NO: 2177 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccctactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2178 - protein, 416 aa, Artificial Sequence; identical to SEQ ID NO: 910
  Description of Artificial Sequence: Synthetic Construct

SEQ ID NO: 2179 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgttgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2180 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVLKRLVHLLVKMRVRPYYIYACDLSLGIGHFRTPVSKGIEIIENLRGHTSGYAVPTFVVHAPGGGGKVPVAPNYVVSQSPRHVVLRNYEGVTTTYTEPEDYHEECDCEDCRAGKHKEGVAALSGGQQLALEPSDLARKKRKFDKN

SEQ ID NO: 2181 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccaagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 2182 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPKNPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDYHEECDCEDCRAGKHKEGVAALSGGQQLALEPSDLARKKRKLDKN

SEQ ID NO: 2183 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttgtcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaatcgcaagatcgataagaactaa

SEQ ID NO: 2184 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLVTDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLALEPSDLARKNRKIDKN

SEQ ID NO: 2185 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcggcgacgaacgcttggaatacatactgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2186 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVGDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVILRNYEGVITTYTEPEDYHEECDCEDCRAGKHKEGVAALSGGQQLALEPSDLARKKRKSDKN

SEQ ID NO: 2187 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctgcactttccggaggtcagcagttggctttagagccttccgacttagctcgcaaaaaacgcaagctcgataagaactaa

SEQ ID NO: 2188 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKLDKN

SEQ ID NO: 2189 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctgtcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttacgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgagggtgttatcacaacctatacggagccggaggactatcatgaggagtgcgattgtgaggactgtcgagccggtaagcataaagagggcgtggctgcactttccggaggtcagcagttggctttagagccttccgacttagctcgcaaaaaacgcaagttcgataagaactaa

SEQ ID NO: 2190 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHLRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKFDKN

SEQ ID NO: 2191 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcggcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctacactttccggaggtcagcagttggctttagagcctcccgacttagctcgcaaaaaacgcaagagcgataagaactaa

SEQ ID NO: 2192 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPRRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRAGKHKEGVATLSGGQQLALEPPDLARKKRKSDKN

SEQ ID NO: 2193 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcacatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagttcgataagaactaa

SEQ ID NO: 2194 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSEHIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKFDKN

SEQ ID NO: 2195 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccaagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2196 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPKNPNCPIRKQAIPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLALEPSDLARKKRKFDKN

SEQ ID NO: 2197 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgcactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtggctacactttccggaggtcagcagttggctttagagcctcccgacttagctcgcaaaaaacgcaagttcgataagaactaa

SEQ ID NO: 2198 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHEECDCEDCRAGKHKEGVATLSGGQQLALEPPDLARKKRKFDKN

SEQ ID NO: 2199 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2200 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKFDKN

SEQ ID NO: 2201 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2202 - protein, 416 aa, Artificial Sequence; identical to SEQ ID NO: 2132
  Description of Artificial Sequence: Synthetic Construct

SEQ ID NO: 2203 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2204 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVTTTYTEPEDYHEECDCEDCRAGKHKEGVAALSGGQQLALEPSDLARKKRKFDKN

SEQ ID NO: 2205 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctgcctttgtggtacatgctccggggggtggtggtaaggtccctttggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2206 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPAFVVHAPGGGGKVPLAPNYVVSQSPRHVILRNYEGVITTYTEPEDYHEECDCEDCRAGKHKEGVAALSGGQQLALEPSDLARKKRKFDKN

SEQ ID NO: 2207 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggcatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2208 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPASKGIEIIENLRGHTSGYAVPTFVVHAPGGGGKVPLAPNYVVSQSPRHVVLRNYEGVTTTYTEPEDYHEECDCEDCRAGKHKEGVAALSGGQQLALEPSDLARKKRKSDKN

SEQ ID NO: 2209 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccagggggtggtggtaaggtccctttggcgccgaactatgtagtatctcagtccccacgacatgtgattcttcgcaattatgaaggtgttatcacaacctatacggagccggaggactatcatgaggagtgcgattgtgaggactgtcgagccggtaagcataaagagggcgtggctgcactttccggaggtcagcagttggctttagagccttccgacttagctcgcaaaaaacgcaagagcgataagaactaa

SEQ ID NO: 2210 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHEECDCEDCRAGKHKEGVAALSGGQQLALEPSDLARKKRKSDKN

SEQ ID NO: 2211 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacaactggcattggcaggtcatcaatcgaattaagacgctcgaccagctggaaaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagctcgataagaactaa

SEQ ID NO: 2212 - protein, 416 aa, Artificial Sequence
  Description of Artificial Sequence: Synthetic Construct
MAESRRKYYFPDVTDEQWYNWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKLDKN

SEQ ID NO: 2213 - DNA, 1251 bp, Artificial Sequence
  Description of Artificial Sequence: Synthetic mutant of Pgaam2 with AAM activity
  CDS (1)..(1251)
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcacttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtgattcttcgcaattatgaaggtgttatcacaacctatacggagccggaggactatcatgaggagtgcgattgtgagtactgtcgagccggtaagcataaagagggcgtggctgcactttccggaggtcagcagttggctttagagccttccgacttagctcgcaaaaaacgcaagttcgataagaactaa

SEQ ID NO: 2214 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVILRNYEGVITTYTEPEDYHEECDCEYCRAGKHKEGVAALSGGQQLALEPSDLARKKRKFDKN

SEQ ID NO: 2215 - DNA, 1251 bp, Artificial Sequence; identical to SEQ ID NO: 127
  Description of Artificial Sequence: Synthetic mutant of Pgaam2 with AAM activity
  CDS (1)..(1251)

SEQ ID NO: 2216 - protein, 416 aa, Artificial Sequence; identical to SEQ ID NO: 128
  Description of Artificial Sequence: Synthetic Construct

SEQ ID NO: 2217 - DNA, 1251 bp, Artificial Sequence; identical to SEQ ID NO: 655
  Description of Artificial Sequence: Synthetic mutant of Pgaam2 with AAM activity
  CDS (1)..(1251)

SEQ ID NO: 2218 - protein, 416 aa, Artificial Sequence; identical to SEQ ID NO: 652
  Description of Artificial Sequence: Synthetic Construct

SEQ ID NO: 2219 - DNA, 1251 bp, Artificial Sequence; identical to SEQ ID NO: 945
  Description of Artificial Sequence: Synthetic mutant of Pgaam2 with AAM activity
  CDS (1)..(1251)

SEQ ID NO: 2220 - protein, 416 aa, Artificial Sequence; identical to SEQ ID NO: 946
  Description of Artificial Sequence: Synthetic Construct

SEQ ID NO: 2221 - DNA, 1251 bp, Artificial Sequence; identical to SEQ ID NO: 2029
  Description of Artificial Sequence: Synthetic mutant of Pgaam2 with AAM activity
  CDS (1)..(1251)

SEQ ID NO: 2222 - protein, 416 aa, Artificial Sequence; identical to SEQ ID NO: 1980
  Description of Artificial Sequence: Synthetic Construct

SEQ ID NO: 2223 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcgggcacacctcgggctatgcagttcctacctttgtggtacatgctccggggggtggtggtaaggtccctgtggcgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtggctgcactttccggaggtcagcagttggctttagagcctcccgacttagctcgcaaaaaacgcaagagcgataagaactaa

SEQ ID NO: 2224 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLALEPPDLARKKRKSDKN

SEQ ID NO: 2225 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgaaggtgttatcacaacctatacggagccggaggactatcatggggagtgcgattgtgaggactgtcgagccggtaagcataaagagggtgtggctgcactttccggaggtcagcagttggctttagagccttccgacttagctcgcaaaaaacgcaggttcgataagaactaa

SEQ ID NO: 2226 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHGECDCEDCRAGKHKEGVAALSGGQQLALEPSDLARKKRRFDKN

SEQ ID NO: 2227 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctaaacactcacttcaaccacccgaatgaagttaccgaagaagcagtggaggcttgtgaaggaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 2228 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACEGMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVTTTYTEPEDYHEECDCEDCRAGKHKEGVAALSGGQQLALEPSDLARKKRKLDKN

SEQ ID NO: 2229 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacgctcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggcgtggctacactttccggaggtcagcagttggctttagagccttccgacttagctcgcaaaaaacgcaagagcgataagaactaa

SEQ ID NO: 2230 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHEECDCEDCRAGKHKEGVATLSGGQQLALEPSDLARKKRKSDKN

SEQ ID NO: 2231 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctggagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgctatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcggagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattattgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2232 - protein, 416 aa, Artificial Sequence
  Description of Artificial Sequence: Synthetic Construct
MAESRRKYYFPDVTDEQWYDWHWQVINRIKTLDQLEKYVTLTAGEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLRGVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKSDKN

SEQ ID NO: 2233 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaagtatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagagcgataagaactaa

SEQ ID NO: 2234 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACGRMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRAGKHKEGVAALSGGQQLALEPSDLARKKRKSDKN

SEQ ID NO: 2235 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2236 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDYHEECDCEDCRAGKHKEGVAALSGGQQLALEPSDLARKKRKFDKN

SEQ ID NO: 2237 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcggttggctttagagccttccgacttagctcgcaaaaaacgcaagttcgataagaactaa

SEQ ID NO: 2238 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQRLALEPSDLARKKRKFDKN

SEQ ID NO: 2239 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatgaccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaaccgaaattatcgaaaatttgcgcggacacacctcgggctatgcagttcctacctttgtggtacatgctccggggggtggtggtaaggtccctgtggcgccgaactatgttgtatctcagtccccacgacatgtgattcttcgcaattatgagggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagagcgataagaactaa

SEQ ID NO: 2240 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMTNAGIPLGNQTVLLRGINDCTHVMKRLVHLLVKMRVRPYYIYACDLSLGIGHFRTPVSKGTEIIENLRGHTSGYAVPTFVVHAPGGGGKVPVAPNYVVSQSPRHVILRNYEGVITTYTEPEDYHEECDCEDCRAGKHKEGVAALSGGQQLALEPSDLARKKRKSDKN

SEQ ID NO: 2241 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattgtttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagttcgataagaactaa

SEQ ID NO: 2242 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYCLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLALEPSDLARKKRKFDKN

SEQ ID NO: 2243 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtggctgcactttccggaggtcagcagttggctttagagcctcccgacttagctcgcaaaaaacgcaagttcgataagaactaa

SEQ ID NO: 2244 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDYHEECDCEDCRAGKHKEGVAALSGGQQLALEPPDLARKKRKFDKN

SEQ ID NO: 2245 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 2246 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVTTTYTEPEDYHEECDCEDCRAGKHKEGVAALSGGQQLALEPSDLARKKRKLDKN

SEQ ID NO: 2247 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2248 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKFDKN

SEQ ID NO: 2249 - DNA, 1251 bp, Artificial Sequence
  Description of Artificial Sequence: Synthetic Construct
atggcagaaagacgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagtgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2250 - protein, 416 aa, Artificial Sequence
  Description of Artificial Sequence: Synthetic Construct
MAERRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRAGKHKEGVAALSGGQQLALEPSDLARKKRKSDKN

SEQ ID NO: 2251 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggcaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctacactttccggaggtcagcagttggctttagagccttccgacttagctcgcaaaaaacgcaagctcgataagaactaa

SEQ ID NO: 2252 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVATLSGGQQLALEPSDLARKKRKLDKN

SEQ ID NO: 2253 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgcggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2254 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPAAPNYVVSQSPRHVVLRNYEGVITTYTEPEDYHEECDCEDCRAGKHKEGVAALSGGQQLALEPSDLARKKRKSDKN

SEQ ID NO: 2255 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaataccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2256 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANTGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKFDKN

SEQ ID NO: 2257 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtgggtatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2258 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVGMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVTTTYTEPEDYHEECDCEDCRAGKHKEGVAALSGGQQLALEPSDLARKKRKSDKN

SEQ ID NO: 2259 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagagcgataagaactaa

SEQ ID NO: 2260 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRAGKHKEGVAALSGGQQLALEPSDLARKKRKSDKN

SEQ ID NO: 2261 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagcctcccgacttagctcgcaaaaaacgcaagttcgataagaactaa

SEQ ID NO: 2262 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVILRNYEGVITTYTEPEDYHEECDCEDCRAGKHKEGVAALSGGQQLALEPPDLARKKRKFDKN

SEQ ID NO: 2263 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctcctcgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagagcgataagaactaa

SEQ ID NO: 2264 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRAGKHKEGVAALSGGQQLALEPSDLARKKRKSDKN

SEQ ID NO: 2265 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagagcgataagaactaa

SEQ ID NO: 2266 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKSDKN

SEQ ID NO: 2267 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccgacaagcataaagagggtgtggctacactttccggaggtcagcagttggctttagagccttccgacttagctcgcaaaaaacgcaagttcgataagaactaa

SEQ ID NO: 2268 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRADKHKEGVATLSGGQQLALEPSDLARKKRKFDKN

SEQ ID NO: 2269 - DNA, 1251 bp, Artificial Sequence
  Description of Artificial Sequence: Synthetic Construct
atggcagaaagtcgtagaaagtattatttccccgatgtcaccgatgagcaatggtacgactggcattggcaggtcaccaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcaccgacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2270 - protein, 416 aa, Artificial Sequence
  Description of Artificial Sequence: Synthetic Construct
MAESRRKYYFPDVTDEQWYDWHWQVTNRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKSDKN

SEQ ID NO: 2271 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacacctacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggtccttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2272 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKSDKN

SEQ ID NO: 2273 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaaccctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttccgacctttgtggtacatgctccggggggtggtggtaaggtccctttggcgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2274 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDYHEECDCEDCRAGKHKEGVAALSGGQQLALEPSDLARKKRKSDKN

SEQ ID NO: 2275 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcagttggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgagggtgttatcacaacctatacggagccggaggactatcatgaggagtgcgattgtgaggactgtcgagccggtaagcataaagagggcgtggctacactttccggaggtcagcagttggctttagagccttccgacttagctcgcaaaaaacgcaagttcgataagaactaa

SEQ ID NO: 2276 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVATLSGGQQLALEPSDLARKKRKFDKN

SEQ ID NO: 2277 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctacactttccggaggtcagcagttggctttagagccttccgacttagctcgcaaaaaacgcaggagcgataagaactaa

SEQ ID NO: 2278 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRAGKHKEGVATLSGGQQLALEPSDLARKKRRSDKN

SEQ ID NO: 2279 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctacactttccggaggtcagcagttggctttagagccttccgacttagctcgcaaaaaacgcaagttcgataagaactaa

SEQ ID NO: 2280 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVATLSGGQQLALEPSDLARKKRKFDKN

SEQ ID NO: 2281 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaaatatcatccggcgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgtcgagccgacaagcataaagagggtgtagctgcactttccggaggtcagcagttggctttagagccttccgacttagctcgcaaaaaacgcaagttcgataagaactaa

SEQ ID NO: 2282 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPAWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRADKHKEGVAALSGGQQLALEPSDLARKKRKFDKN

SEQ ID NO: 2283 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgagggtgttatcacaacctatacggagccggaggactatcatgaggagtgcgattgtgaggactgtcgagtcggtaagcataaagagggtgtggctacactttccggaggtcagcagttggctttagagccttccgacttagctcgcaaaaaacgcaagttcgataagaactaa

SEQ ID NO: 2284 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLINPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRVGKHKEGVATLSGGQQLALEPSDLARKKRKFDKN

SEQ ID NO: 2285 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttattacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctttgcagttcctacctttgtggtacatgctccggggggtggtggtaaggtccctttggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggcgtggctacactttccggaggtcagcagttggctttagagccttccgacttagctcgcaaaaaacgcaagttcgataagaactaa

SEQ ID NO: 2286 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGFAVPTFVVHAPGGGGKVPLAPNYVVSQSPRHVILRNYEGVITTYTEPEDYHEECDCEDCRAGKHKEGVATLSGGQQLALEPSDLARKKRKFDKN

SEQ ID NO: 2287 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2288 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKFDKN

SEQ ID NO: 2289 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgagggtgttaccacaacctatacggagccggaggactgtcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2290 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDCHEECDCEDCRAGKHKEGVAALSGGQQLALEPSDLARKKRKFDKN

SEQ ID NO: 2291 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagggggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctgtcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccccgtggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtggctgcactttccggaggtcagcagttggctttagagcctcccgacttagctcgcaaaaaacgcaagagcgataagaactaa

SEQ ID NO: 2292 - protein, 416 aa, Artificial Sequence
  Description of Artificial Sequence: Synthetic Construct
MAESRRKYYFPDVTDEQWYDWHWQVINRIKTLDQLEKYVTLTAEEEGGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVILRNYEGVITTYTEPEDYHEECDCEDCRAGKHKEGVAALSGGQQLALEPPDLARKKRKSDKN

SEQ ID NO: 2293 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcgttgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagctcgataagaactaa

SEQ ID NO: 2294 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCVDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKLDKN

SEQ ID NO: 2295 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaacgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctgcactttccggaggtcagcagttggctttagagccttccgacttagctcgcaaaaaacgcaagagcgataagaactaa

SEQ ID NO: 2296 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKSDKN

SEQ ID NO: 2297 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtgctccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcctgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 2298 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVAALSGGQQLALEPSDLARKKRKLDKN

SEQ ID NO: 2299 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagctggtaagcataaagagggtgtagctgcactttccggaggtcagcagttggctttagagccttccgacttagctcgcaaaaaacgcaagttcgataagaactaa

SEQ ID NO: 2300 - protein, 416 aa, Artificial Sequence; identical to SEQ ID NO: 910
  Description of Artificial Sequence: Synthetic Construct

SEQ ID NO: 2301 - DNA, 1251 bp, Artificial Sequence
  Description of Artificial Sequence: Synthetic Construct
atggcagaaagtcgtagagagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctacactttccggaggtcagcagttggctttagagccttccgacttagctcgcaaaaaacgcaagttcgataagaactaa

SEQ ID NO: 2302 - protein, 416 aa, Artificial Sequence
  Description of Artificial Sequence: Synthetic Construct
MAESRREYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVATLSGGQQLALEPSDLARKKRKFDKN

SEQ ID NO: 2303 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2304 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHEECDCEDCRAGKHKEGVAALSGGQQLALEPSDLARKKRKFDKN

SEQ ID NO: 2305 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagttcgataagaactaa

SEQ ID NO: 2306 - protein, 416 aa, Artificial Sequence; identical to SEQ ID NO: 910
  Description of Artificial Sequence: Synthetic Construct

SEQ ID NO: 2307 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtgattcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2308 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVILRNYEGVTTTYTEPEDYHEECDCEDCRAGKHKEGVAALSGGQQLALEPSDLARKKRKFDKN

SEQ ID NO: 2309 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctacccaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2310 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVTTTYTEPEDYHEECDCEDCRAGKHKEGVAALSGGQQLALEPSDLARKKRKFDKN

SEQ ID NO: 2311 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcgacaggaactggtacgtgctcccgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgttagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttactgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctgaactttccggaggtcagcagttggctttagagccttccgacttagctcgcaaaaaacgcaagagcgataagaactaa

SEQ ID NO: 2312 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAELSGGQQLALEPSDLARKKRKSDKN

SEQ ID NO: 2313 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatccaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacctagctcgcaaaaaacgcaagctcgataagaactaa

SEQ ID NO: 2314 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKLDKN

SEQ ID NO: 2315 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 2316 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQRDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVTTTYTEPEDYHEECDCEDCRAGKHKEGVAALSGGQQLALEPSDLARKKRKLDKN

SEQ ID NO: 2317 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2318 - protein, 416 aa, Artificial Sequence; identical to SEQ ID NO: 2210
  Description of Artificial Sequence: Synthetic Construct

SEQ ID NO: 2319 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctacactttccggaggtcagcagttggctttagagccttccgacttagctcgcaaaaaacgcaagctcgataagaactaa

SEQ ID NO: 2320 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVATLSGGQQLALEPSDLARKKRKLDKN

SEQ ID NO: 2321 - DNA, 1251 bp, Artificial Sequence
  Description of Artificial Sequence: Synthetic Construct
atggcagaaagtcgtagaaagtattatttccccgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagttcgataagaactaa

SEQ ID NO: 2322 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDYHEECDCEDCRAGKHKEGVAALSGGQQLALEPSDLARKKRKFDKN

SEQ ID NO: 2323 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatggttgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtgattcttcgcaattatgaaggtgttatcacaacctatacggagccggaggactatcatgaggagtgcgattgtgaggactgtcgagccgacaagcataaagagggtgtagctgcactttccggaggtcagcagttggctttagagccttccgacttagctcgcaaaaaacgcaagagcgataagaactaa

SEQ ID NO: 2324 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINGCTHVMKRLVHLLVKMRVRPYYIYACDLSLGIGHFRTPVSKGIEIIENLRGHTSGYAVPTFVVHAPGGGGKVPIAPNYVVSQSPRHVILRNYEGVITTYTEPEDYHEECDCEDCRADKHKEGVAALSGGQQLALEPSDLARKKRKSDKN

SEQ ID NO: 2325 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaggagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagttcgataagaactaa

SEQ ID NO: 2326 - protein, 416 aa, Artificial Sequence; identical to SEQ ID NO: 2132
  Description of Artificial Sequence: Synthetic Construct

SEQ ID NO: 2327 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaacgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggcgtggctgcactttccggaggtcagcagttggctttagagccttccgacttagctcgcaaaaaacgcaagctcgataagaactaa

SEQ ID NO: 2328 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKLDKN

SEQ ID NO: 2329 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctacactttccggaggtcagcagttggctttagagccttccgacttagctcgcaaaaaacgcaagagcgataagaactaa

SEQ ID NO: 2330 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRAGKHKEGVATLSGGQQLALEPSDLARKKRKSDKN

SEQ ID NO: 2331 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcggattaagacgctcgaccagctggaaaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagctcgataagaactaa

SEQ ID NO: 2332 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDYHEECDCEDCRAGKHKEGVAALSGGQQLALEPSDLARKKRKLDKN

SEQ ID NO: 2333 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgaaggtgttatcacaacctatacggagccggaggactatcatggggagtgcgattgtgaggactgtcgagccggtaagcataaagagggtgtagctgcactttccggaggtcagcagttggctttagagcctcccgacttagctcgcaaaaaacgcaagagcgataagaactaa

SEQ ID NO: 2334 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHGECDCEDCRAGKHKEGVAALSGGQQLALEPPDLARKKRKSDKN

SEQ ID NO: 2335 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctccagaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgagggtgttatcacaacctatacggagccggaggactatcatgaggagtgcgattgtgaggactgtcgagccggtaagcataaagagggtgtggctacactttccggaggtcagcagttggctttagagccttccgacttagctcgcaaaaaacgcaagctcgataagaactaa

SEQ ID NO: 2336 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVITTYTEPEDYHEECDCEDCRAGKHKEGVATLSGGQQLALEPSDLARKKRKLDKN

SEQ ID NO: 2337 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagctcgataagaactaa

SEQ ID NO: 2338 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDYHEECDCEDCRAGKHKEGVAALSGGQQLALEPSDLARKKRKLDKN

SEQ ID NO: 2339 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagcctcccgacttagctcgcaaaaaacgcaagttcgataagaactaa

SEQ ID NO: 2340 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDYHEECDCEDCRAGKHKEGVAALSGGQQLALEPPDLARKKRKFDKN

SEQ ID NO: 2341 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgagggtgttatcacaacctatacggagccggaggactatcatgaggagtgcgattgtgaggactgtcgagccggtaagcataaagagggcgtggctgcactttccggaggtcagcagttggctttagagccttccgacttagctcgcaaaaaacgcaagagcgataagaactaa

SEQ ID NO: 2342 - protein, 416 aa, Artificial Sequence; identical to SEQ ID NO: 2264
  Description of Artificial Sequence: Synthetic Construct

SEQ ID NO: 2343 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgactgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtggctacactttccggaggtcagcagttggctttagagccttccgacttagctcgcaaaaaacgcaagttcgataagaactaa

SEQ ID NO: 2344 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVATLSGGQQLALEPSDLARKKRKFDKN

SEQ ID NO: 2345 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggtggcgatgccctccttgtcagcgacgaacgcttggaatacatactgaagcgtctgcgcgaagtacctcatgtggagattgttcgtatagggacccgcacgccggtagtcctccctcagcgtatgacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtggctgcactttccggaggtcagcagttggctttagagcctcccgacttagctcgcaaaaaacgcaagagcgataagaactaa

SEQ ID NO: 2346 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGTRTPVVLPQRMTPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHEECDCEDCRAGKHKEGVAALSGGQQLALEPPDLARKKRKSDKN

SEQ ID NO: 2347 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcggcgacgaacgcttggaatacatactgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtgattcttcgcaattatgaaggtgttaccacaacctatacggagccggaggactatcatgaggagtgcgattgtgaggactgtcgagccgacaagcataaagagggtgtggctgcactttccggaggtcagcagttggctttagagccttccgacttagctcgcaaaaaacgcaagagcgataagaactaa

SEQ ID NO: 2348 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRRCTRRRFAGQKDASSPSERIDRCIEYIANTPTVRDVLLSGGDALLVGDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVILRNYEGVTTTYTEPEDYHEECDCEDCRADKHKEGVAALSGGQQLALEPSDLARKKRKSDKN

SEQ ID NO: 2349 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaggaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagactggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgagggtgttatcacaacctatacggagccggaggactatcatgaggagtgcgattgtgaggactgtcgagccggtaagcataaagagggtgtggctacactttccggaggtcagcagttggctttagagccttccgacttagctcgcaaaaaacgcaagctcgataagaactaa

SEQ ID NO: 2350 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHEECDCEDCRAGKHKEGVATLSGGQQLALEPSDLARKKRKLDKN

SEQ ID NO: 2351 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatactgaagcgtctgcgcgaagtacctcatgtggagattgttcgtatagggagccgcacgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgaaggcgttatcacaacctatacggagccggaggactatcatgaggagtgcgattgtgaggactgtcgagccgacaagcataaagagggtgtggctgcactttccggaggtcagcagttggctttagagcctcccgacttagctcgcaaaaaacgcaagagcgataagaactaa

SEQ ID NO: 2352 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHEECDCEDCRADKHKEGVAALSGGQQLALEPPDLARKKRKSDKN

SEQ ID NO: 2353 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgtacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgagggtgttaccacaacctatacggagccggaggactatcatgaggagtgcgattgtgaggactgtcgagccggtaagcataaagagggtgtggctgcactttccggaggtcagcagttggctttagagccttccgacttagctcgcaaaaaacgcaagttcgataagaactaa

SEQ ID NO: 2354 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFTGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPIAPNYVVSQSPRHVVLRNYEGVTTTYTEPEDYHEECDCEDCRAGKHKEGVAALSGGQQLALEPSDLARKKRKFDKN

SEQ ID NO: 2355 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacacactgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2356 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYTLKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLALEPSDLARKKRKSDKN

SEQ ID NO: 2357 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgcacgccggtagtcctccctcagcgtataacgcctcaattggtggatatgctcaaaaaatatcatccggtgtggctgaacactcacttcaaccacccgaatgaagttaccgaagaagcagtgggggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgtcgagccggtaagcataaagagggtgtagctgcactttccggaggtcagcagttggttttagagccttccgacttagctcgcaaaaaacgcaagagcgataagaactaa

SEQ ID NO: 2358 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIDYIANTPTVRDVLLSGGDALLVSDERLEYILKRLREVPHVEIVRIGSRTPVVLPQRITPQLVDMLKKYHPVWLNTHFNHPNEVTEEAVGACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRAGKHKEGVAALSGGQQLVLEPSDLARKKRKSDKN

SEQ ID NO: 2359 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaaaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttaccacaacctatacggagccggaggactatcatgaggagtgcgattgtgaggactgtcgagccggtaagcataaagagggtgtagctgcactttccggaggtcagcagttggctttagagccttccgacttagctcgcaaaaaacgcaagagcgataagaactaa

SEQ ID NO: 2360 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVVLRNYEGVTTTYTEPEDYHEECDCEDCRAGKHKEGVAALSGGQQLALEPSDLARKKRKSDKN

SEQ ID NO: 2361 - DNA, 1251 bp, Artificial Sequence
  Description of Artificial Sequence: Synthetic Construct
gtggcagaaagtcgtagaaagtattatttccctgatgtcaccgatgagcaatggtacgactggcattggcaggtcatcaatcgaattaagacgctcgaccagctggaaaagtacgttactctcaccgctgaagaggaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagaaagatgcttcttctccttctgagcgcatcgatcgatgcattgactatatagccaatacaccgacagtccgcgatgttttgctatcgggaggcgatgccctccttgtcagcgacgaacgcttggaatacatattgaagcgtctgcgcgaagtacctcatgtggagattgttcgtatagggacccgcacgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtgattcttcgcaattatgaaggtgttatcacaacctatacggagccggaggactatcatgaggagtgcgattgtgaggactgtcgagccggtaagcataaagagggtgtggctgcactttccggaggtcagcagttggctttagagcctcccgacttagctcgcaaaaaacgcaagctcgataagaactaa

SEQ ID NO: 2362 - protein, 416 aa, Artificial Sequence
  Description of Artificial Sequence: Synthetic Construct
VAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRRCTRRRFAGQKDASSPSERIDRCIDYIANTPTVRDVLLSGGDALLVSDERLEYILKRLREVPHVEIVRIGTRTPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKVPLAPNYVVSQSPRHVILRNYEGVITTYTEPEDYHEECDCEDCRAGKHKEGVAALSGGQQLALEPPDLARKKRKLDKN

SEQ ID NO: 2363 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccagttagtgaagatgaagattcgcccgtacccggactgactcattgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2364 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRAPEDMVDPVSEDEDSPVPGLTHCYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKIRVRPYYIYACDLSFGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERKFDKN

SEQ ID NO: 2365 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2366 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRSPEDMVDPLSEDEDSPVPGLTHRYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2367 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcacttcgcaggacggaaagatgcttcttctccttctgtgcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2368 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRHFAGRKDASSPSVRIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSFGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKKRKFDKN

SEQ ID NO: 2369 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagggtcgcccaaagtactccgaatggctatcacaccttattatttgagtttgatagaccccgagaatcctaaatgtccgattcgtaaacaagccattcctactcaacaggaactggtacgtgctcctgaagatatggtagacccagttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctataacgccgaactatgttgtatctcagtccccacgacatgtggttcttcgcaattatgaaggtgctatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagttcgataagaactaa

SEQ ID NO: 2370 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKGSPKVLRMAITPYYLSLIDPENPKCPIRKQAIPTQQELVRAPEDMVDPVSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKVRVRPYYIYACDLSFGIGHFRTPVSKGIEIIENLRGHTSGYAVPTFVVHAPGGGGKIPITPNYVVSQSPRHVVLRNYEGAITTYTEPEDYHEECDCEDCRADEHKEGVAALSGGQQLALEPPDLARKERKFDKN

SEQ ID NO: 2371 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactagccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtgaaaaaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2372 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTSRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVVACEKMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2373 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccagttagtgaagatgaagattcgcccgtacccggactgactcatcgttatccggatcgtgtattgttccttatcacggacaaatgttcgatgtacagtcgtcattgtactagccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagttcgataagaactaa

SEQ ID NO: 2374 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRAPEDMVDPVSEDEDSPVPGLTHRYPDRVLFLITDKCSMYSRHCTSRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2375 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtacagtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaggcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcggaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagtttgataagaactaa

SEQ ID NO: 2376 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYSRHCTRRRFAGQKDASSPSERIDRCIEYIANTPTVRDVLLSGGDALLVSDERLEYILRRLREVPHVEIVRIGSRAPVVLPQRITPQLVDMLKKYHPVWLNTHFNHPNEVTEEAVVACERMANAGIPLGNQTVLLRGINDCTHVMKRLVHLLVKVRVRPYYIYACDLSLGIGHFRTPVSKGIGIIENLRGHTSGYAVPTFVVHAPGGGGKIPVTPNYVVSQSPRHVVLRNYEGAITTYTEPEDYHEECDCEDCRADEHKEGVAALSGGQQLALEPPDLARKERKFDKN

SEQ ID NO: 2377 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatccatcgaattaagacgctcgaccagctggagaagtacgttacactcaccgctgaagaagaagagggagtacaagaatcgcccaaagtactccgaatggctatcacaccttattatttgagtttgttagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgtatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagttcgataagaactaa

SEQ ID NO: 2378 - protein, 416 aa, Artificial Sequence
  Description of Artificial Sequence: Synthetic Construct
MAESRRKYYFPDVTDEQWYDWHWQVIHRIKTLDQLEKYVTLTAEEEEGVQESPKVLRMAITPYYLSLLDPENPKCPIRKQAIPTQQELVRSPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSFGIGHFRTPVSKGIEIIENLRGHTSGYAVPTFVVHAPGGGGKIPVTPNYVVSQSPRHVVLRNYEGAITTYTEPEDYHEECDCEDCRADEHKEGVAALSGGQQLALEPPDLARKERKFDKN

SEQ ID NO: 2379 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgttctcctgaagatatggtagacccagttagtgaagatgaagattcgcccgtacccggactgactcatcgttatccggatcgtgtattgttccttatcacggacaaatgttcgatgtacagtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtgctggtaagatacctgtaacgccgaactatgttgtatctcagtccccacgacatgtggttcttcgcaattatgaaggtgttatcacaacctatgcggagccggaggactatcatgaggagtgcgattgtgaggactgccgagccgacgagcataaagagggcgtggctgcactttccggaggtcggcagttggctttagagcctcccgacttagctcgcaaaaaacgcaagtttgataagaactaa

SEQ ID NO: 2380 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRSPEDMVDPVSEDEDSPVPGLTHRYPDRVLFLITDKCSMYSRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKIRVRPYYIYACDLSFGIGHFRTPVSKGIEIIENLRGHTSGYAVPTFVVHAPGGAGKIPVTPNYVVSQSPRHVVLRNYEGVITTYAEPEDYHEECDCEDCRADEHKEGVAALSGGRQLALEPPDLARKKRKFDKN

SEQ ID NO: 2381 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgttctcctgaagatatggtagacccagttagtgaagatgaagattcgcccgtacccggactgactcatcgttatccggatcgtgtattgttccttatcacggacaaatgttcgatgtacagtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2382 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRSPEDMVDPVSEDEDSPVPGLTHRYPDRVLFLITDKCSMYSRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSFGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERKFDKN

SEQ ID NO: 2383 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcaatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2384 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRSPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERKFDKN

SEQ ID NO: 2385 - DNA, 1251 bp, Artificial Sequence
  Description of Artificial Sequence: Synthetic Construct
atggcagaaagtcgtagaaagtattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatgtggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2386 - protein, 416 aa, Artificial Sequence
  Description of Artificial Sequence: Synthetic Construct
MAESRRKYYFPDVTDEQWYNWHWQVINRIKTLDQLEKYVTLTAEEEEGVKESPKVLRMAITPYYLSLIDPENPNCPIRKQAIPTQQELVRAPEDVVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSFGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERKFDKN

SEQ ID NO: 2387 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2388 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRSPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKKRKFDKN

SEQ ID NO: 2389 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccagttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2390 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRAPEDMVDPVSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSFGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2391 - DNA, 1251 bp, Artificial Sequence
  Description of Artificial Sequence: Synthetic Construct
atggcagaaagtcgtagaaagtattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagtctcccgacttagctcgcaaagaacgcaagttcgataagaactaa

SEQ ID NO: 2392 - protein, 416 aa, Artificial Sequence
  Description of Artificial Sequence: Synthetic Construct
MAESRRKYYFPDVTDEQWYNWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALESPDLARKERKFDKN

SEQ ID NO: 2393 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgtgtttgatagaccccgagaatcctaaatgtccgattcgtaaacaaaccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatgcatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2394 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLCLIDPENPKCPIRKQTIPTQQELVRSPEDMVDPLSEDEDSPVPGLTHRYPDRVLFLITDKCSMYCRHCTRRRFAGQKDASSPSERIDRCIEYIANTPAVRDVLLSGGDALLVSDERLECILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKVRVRPYYIYACDLSFGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2395 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccagttagtgaagatgaagattcgcccgtacccggactgactcatcgttatccggatcgtgtattgttccttatcacggacaaatgttcgatgtacagtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtagtggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagttcgataagaactaa

SEQ ID NO: 2396 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPKCPIRKQAIPTQQELVRSPEDMVDPVSEDEDSPVPGLTHRYPDRVLFLITDKCSMYSRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKIRVRPYYIYACDLSFGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2397 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagactcacttagtgaagatgaagattcgcccgtacccggactgactcatcgttatccggatcgtgtattgttccttatcacggacaaatgttcgatgtactgtcgtcattgtactagccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatcaaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2398 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDSLSEDEDSPVPGLTHRYPDRVLFLITDKCSMYCRHCTSRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSFGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2399 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactagccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatggggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2400 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRSPEDMVDPLSEDEDSPVPGLTHRYPDRVLFLITDKCSMYCRHCTSRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGMGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2401 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgtgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccacacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2402 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGRKDASSPSERIDRCIEYIANTPAVRDVLLSGGDALLVSDERLEYILKRLCEVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSMGIGHFHTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2403 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccagttagtgaagatgaagattcgcccgtacccggactgactcatcgttatccggatcgtgtattgttccttatcacggacaaatgttcgatgtacagtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2404 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRSPEDMVDPVSEDEDSPVPGLTHRYPDRVLFLITDKCSMYSRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERKFDKN

SEQ ID NO: 2405 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccagttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccgatagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2406 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRAPEDMVDPVSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPIVLPQRITPQLVDMLKKYHPVWLNTHFNHPNEVTEEAVEACERMANAGIPLGNQTVLLRGINDCTHVMKRLVHLLVKIRVRPYYIYACDLSFGIGHFRTPVSKGIEIIENLRGHTSGYAVPTFVVHAPGGGGKIPVTPNYVVSQSPRHVVLRNYEGAITTYTEPEDYHEECDCEDCRADEHKEGVAALSGGQQLALEPPDLARKKRKFDKN

SEQ ID NO: 2407 - DNA, 1251 bp, Artificial Sequence
  Description of Artificial Sequence: Synthetic Construct
atggcagaaagtcgtagaaagtattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtatatttgctggtaaagattcgtgtgcgtccttactatatatatgcttgcgatctttcgatgggaatagggcatttccgcacgccggtatctaaaggaatcgaaattatcgaaaatttgcgcggacacaccttgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2408 - protein, 416 aa, Artificial Sequence
  Description of Artificial Sequence: Synthetic Construct
MAESRRKYYFPDVTDEQWYNWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVYLLVKIRVRPYYIYACDLSMGIGHFRTPVSKGIEIIENLRGHTLGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2409 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccagttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagttcgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2410 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPKCPIRKQAIPTQQELVRAPEDMVDPVSEDEDSPVPGLTHRYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKVRVRPYYIYACDLSFGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2411 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacgctcacttcaaccacccgaatgaagttaccgaagaagcagtggtggcttgtgaaagaatggccaatgccggtattccgttgggtaaccaaacggttttattgcgtggagtcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaggtttgataagaactaa

SEQ ID NO: 2412 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNAHFNHPNEVTEEAVVACERMANAGIPLGNQTVLLRGVNDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRRFDKN

SEQ ID NO: 2413 - DNA, 1251 bp, Artificial Sequence
  Description of Artificial Sequence: Synthetic Construct
atggcagaaagtcgtagaaagtattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgccccaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2414 - protein, 416 aa, Artificial Sequence
  Description of Artificial Sequence: Synthetic Construct
MAESRRKYYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERKFDKN

SEQ ID NO: 2415 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2416 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERKFDKN

SEQ ID NO: 2417 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttctccgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2418 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRSPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2419 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2420 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2421 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatagccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagtttgataagaactaa

SEQ ID NO: 2422 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERIANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADEHKEGVAALSGGQQLALEPPDLARKERKFDKN

SEQ ID NO: 2423 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcctgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2424 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2425 - DNA, 1251 bp, Artificial Sequence
  Description of Artificial Sequence: Synthetic Construct
atggcagaaagtcgtagaaagtattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2426 - protein, 416 aa, Artificial Sequence
  Description of Artificial Sequence: Synthetic Construct
MAESRRKYYFPDVTDEQWYNWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2427 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2428 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2429 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagttcgataagaactaa

SEQ ID NO: 2430 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRSPEDMVDPLSEDEDSPVPGLTHRYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2431 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2432 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERKFDKN

SEQ ID NO: 2433 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagtttgataagaactaa

SEQ ID NO: 2434 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKIRVRPYYIYACDLSFGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2435 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacgctcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcaaaaagagggcgtggctgcactttccggaggtcagcagttggctttagagcctcccgacttagctcgcaaaaaacgcaagttcgataagaactaa

SEQ ID NO: 2436 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADKQKEGVAALSGGQQLALEPPDLARKKRKFDKN

SEQ ID NO: 2437 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2438 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2439 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2440 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2441 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcccacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2442 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPKCPIRKQAIPTQQELVRSPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKKRKFDKN

SEQ ID NO: 2443 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2444 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2445 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2446 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACGRMANAGIPLGNQTVLLRGINDCTHVMKRLVHLLVKMRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2447 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgaatatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgtttggaatagggcatttccgcacgccggtatctaaaggaatcgaaattaacgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2448 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSFGIGHFRTPVSKGIEINENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2449 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2450 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERKFDKN

SEQ ID NO: 2451 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagtttgataagaactaa

SEQ ID NO: 2452 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRSPEDMVDPLSEDEDSPVPGLTHRYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2453 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcggtgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2454 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRSPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSFGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2455 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagtttgataagaactaa

SEQ ID NO: 2456 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKIRVRPYYIYACDLSFGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2457 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2458 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKVRVRPYYIYACDLSFGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2459 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagtttgataagaactaa

SEQ ID NO: 2460 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRSPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2461 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagactgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttggtaagaactaa

SEQ ID NO: 2462 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVETVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFGKN

SEQ ID NO: 2463 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagttcgataagaactaa

SEQ ID NO: 2464 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADEHKEGVAALSGGQQLALEPPDLARKKRKFDKN

SEQ ID NO: 2465 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2466 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRSPEDMVDPLSEDEDSPVPGLTHRYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERKFDKN

SEQ ID NO: 2467 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2468 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRSPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKKRKFDKN

SEQ ID NO: 2469 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagttcgataagaactaa

SEQ ID NO: 2470 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRSPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2471 - DNA, 1251 bp, Artificial Sequence
  Description of Artificial Sequence: Synthetic Construct
atggcagaaagtcgtagaaagtattatttccctgatgtcaccgatgagcaatggtacaactggcattggcaggtcatcaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctgtcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagtttgataagaactaa

SEQ ID NO: 2472 - protein, 416 aa, Artificial Sequence
  Description of Artificial Sequence: Synthetic Construct
MAESRRKYYFPDVTDEQWYNWHWQVINRIKTLDQLEKYVALTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2473 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagttcgataagaactaa

SEQ ID NO: 2474 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2475 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctcattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2476 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPHCPIRKQAIPTQQELVRAPEDMVDPLSEDEDSPVPGLTHRYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKKRKFDKN

SEQ ID NO: 2477 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagtttgataagaactaa

SEQ ID NO: 2478 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2479 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagagtcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2480 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADEHKEGVAALSGGQQLALEPPDLARKKRKFDKN

SEQ ID NO: 2481 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactagccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2482 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTSRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSFGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2483 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2484 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2485 - DNA, 1251 bp, Artificial Sequence
  Description of Artificial Sequence: Synthetic Construct
atggcagaaagtcgtagaaagtattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggggccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2486 - protein, 416 aa, Artificial Sequence
  Description of Artificial Sequence: Synthetic Construct
MAESRRKYYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTGPEDYHEECDCEDCRADEHKEGVAALSGGQQLALEPPDLARKKRKFDKN

SEQ ID NO: 2487 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtaatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2488 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKKRKFDKN

SEQ ID NO: 2489 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2490 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPKCPIRKQAIPTQQELVRSPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVVACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2491 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2492 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRSPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSFGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERKFDKN

SEQ ID NO: 2493 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagtttgataagaactaa

SEQ ID NO: 2494 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSFGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2495 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaagaaacgcaagtttgataagaactaa

SEQ ID NO: 2496 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2497 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacacccaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2498 - protein, 416 aa, Artificial Sequence
  Description of Artificial Sequence: Synthetic Construct
MAESRRKHYFPDVTDEQWYNWHWQVINRIKTLDQLEKYVTPTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2499 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgtttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataggaactaa

SEQ ID NO: 2500 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSFGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDRN

SEQ ID NO: 2501 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtacagtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2502 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTQQELVRSPEDMVDPLSEDEDSPVPGLTHRYPDRVLFLITDKCSMYSRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADEHKEGVAALSGGQQLALEPPDLARKKRKFDKN

SEQ ID NO: 2503 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgattgaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2504 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKKRKFDKN

SEQ ID NO: 2505 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatgaccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2506 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMTNAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2507 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2508 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2509 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2510 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2511 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2512 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKKRKFDKN

SEQ ID NO: 2513 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaataggacatttccgcacgccggtatctaaaggaatcgaaattatcgaaaatttgcgcggacacacctcgggctatgcagttcctaccttcgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2514 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKKRKFDKN

SEQ ID NO: 2515 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2516 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2517 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2518 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVVACGRMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2519 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2520 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2521 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2522 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKKRKFDKN

SEQ ID NO: 2523 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2524 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2525 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacacctcattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacgagcataaagagggcgtggctgcactttccggaggtcagcagttggctttagagcctcccgacttagctcgcaaagaacgcaagtttgataagaactaa

SEQ ID NO: 2526 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPHYLSLIDPENPKCPIRKQAIPTQQELVRSPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2527 - DNA, 1251 bp, Artificial Sequence
  Description of Artificial Sequence: Synthetic Construct
atggcagaaagtcgtagaaagtattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacgagcataaagagggcgtggctgcactttccggaggtcagcagttggctttagagcctcccgacttagctcgcaaaaaacgcaagtttgataagaactaa

SEQ ID NO: 2528 - protein, 416 aa, Artificial Sequence
  Description of Artificial Sequence: Synthetic Construct
MAESRRKYYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSMGIGHFRTPVSKGIEIIENLRGHTSGYAVPTFVVHAPGGGGKIPVTPNYVVSQSPRHVVLRNYEGAITTYTEPEDYHEECDCEDCRADEHKEGVAALSGGQQLALEPPDLARKKRKFDKN

SEQ ID NO: 2529 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2530 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2531 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaggcagtggaggcttgtggaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2532 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2533 - DNA, 1251 bp, Artificial Sequence
  Description of Artificial Sequence: Synthetic Construct
atggcagaaagtcgtagaaagcattatttccctgatgtcaccgatgagcaatggtacaactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccggcagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2534 - protein, 416 aa, Artificial Sequence
  Description of Artificial Sequence: Synthetic Construct
MAESRRKHYFPDVTDEQWYNWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGRKDASSPSERIDRCIEYIANTPAVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2535 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgttctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatgcatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgatgggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgactgtgaggactgccgagccgacgagcataaagagggcgtggctgcactttccggaggtcagcagttggctttagagcctcccgacttagctcgcaaagaacgcaagttcgataagaactaa

SEQ ID NO: 2536 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRSPEDMVDPLSEDEDSPVPGLTHRYPDRVLFLITDKCSMYCRHCTRRRFAGQKDASSPSERIDRCIEYIANTPTVRDVLLSGGDALLVSDERLECILKRLREVPHVEIVRIGSRAPVVLPQRITPQLVDMLKKYHPVWLNTHFNHPNEVTEEAVVACERMANAGIPLGNQTVLLRGINDCTHVMKRLVHLLVKIRVRPYYIYACDLSMGIGHFRTPVSKGIEIIENLRGHTSGYAVPTFVVHAPGGGGKIPVTPNYVVSQSPRHVVLRNYEGVITTYTEPEDYHEECDCEDCRADEHKEGVAALSGGQQLALEPPDLARKERKFDKN

SEQ ID NO: 2537 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaaatgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaagttcgataagaactaa

SEQ ID NO: 2538 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPKCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKERKFDKN

SEQ ID NO: 2539 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggcctatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacgtgtggttcttcgcaattatgaaggtgttatcacaacctatacggagccggaggactatcatgaggagtgcgattgtgaggactgccgagtcgacaagcatcgtgagggcgtggctgcactttccgaaggtcagcagttggctttagagcctcccgacttagctcgcaaaaaacgcaggagcgataagaactaa

SEQ ID NO: 2540 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMAYAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRRVVLRNYEGVITTYTEPEDYHEECDCEDCRVDKHREGVAALSEGQQLALEPPDLARKKRRSDKN

SEQ ID NO: 2541 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggagaactatcatgaggagtgcgattgtgaggactgccgagtcgacaagcataaagagggcgtggctgcactttccggaggtcagcagttggctttagagcctcccgacttagctcgcaaaaaacgcaagtttgataagaactaa

SEQ ID NO: 2542 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEIIENLRGHTSGYAVPTFVVHAPGGGGKIPLAPNYVVSQSPRHVVLRNYEGVITTYTEPENYHEECDCEDCRVDKHKEGVAALSGGQQLALEPPDLARKKRKFDKN

SEQ ID NO: 2543 - DNA, 1251 bp, Artificial Sequence
  Description of Artificial Sequence: Synthetic Construct
atggcagaaagtcgcagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggagaactatcatgaggagtgcgattgtgaggactgccgagccggcaagcataaagagggcgtggctgcactttccggaggtcagcagttggctttagagcctcccgacttagctcgcaaaaaacgcaagtttgataagaactaa

SEQ ID NO: 2544 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRRVVLRNYEGVITTYTEPENYHEECDCEDCRAGKHKEGVAALSGGQQLALEPPDLARKKRKFDKN

SEQ ID NO: 2545 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtaacgccgaactatgttgtatctcagtccccacgacatgtggttcttcgcaattatgaaggtgttatcacaacctatacggagccggagaactatcatgaggagtgcgattgtgaggactgccgagtcgacaagcataaagagggcgtggctgcactttccgaaggtcagcagttggctttagagcctcccgacttagctcgcaaaaaacgcaagtttgataagaactaa

SEQ ID NO: 2546 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIENLRGHTSGYAVPTFVVHAPGGGGKVPVTPNYVVSQSPRHVVLRNYEGVITTYTEPENYHEECDCEDCRVDKHKEGVAALSEGQQLALEPPDLARKKRKFDKN

SEQ ID NO: 2547 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggagaactatcatgaggagtgcgattgtgaggactgccgagtcgacaagcataaagagggcgtggctgcactttccggaggtcagcagttggctttagagcctcccgacttagctcgcaaaaaacgcaggctcgataagaactaa

SEQ ID NO: 2548 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPENYHEECDCEDCRVDKHKEGVAALSGGQQLALEPPDLARKKRRLDKN

SEQ ID NO: 2549 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagattcgtgtgcgcccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggctcgataagaactaa

SEQ ID NO: 2550 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKGLVHLLVKIRVRPYYIYACDLSLGIGHFRTPVSKGIEIIESLRGHTSGYAVPTFVVHAPGGGGKIPLAPNYVVSQSPRHVVLRNYEGVITTYTEPEDYHEECDCEDCRVDKHREGVAALSGGQQLALEPPDLARKKRRLDKN

SEQ ID NO: 2551 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggcctatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2552 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMAYAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2553 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacgtgtggttcttcgcaattatgaaggtgttatcacaacctatacggagccggagaactatcatgaggagtgcgattgtgaggactgccgagtcgacaagcataaagagggcgtggctgcactttccggaggtcagcagttggctttagagcctcccgacttagctcgcaaaaaacgcaagttcgataagaactaa

SEQ ID NO: 2554 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEIIENLRGHTSGYAVPTFVVHAPGGGGKIPVTPNYVVSQSPRRVVLRNYEGVITTYTEPENYHEECDCEDCRVDKHKEGVAALSGGQQLALEPPDLARKKRKFDKN

SEQ ID NO: 2555 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttgacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaagtttgataagaactaa

SEQ ID NO: 2556 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKVPLTPNYVVSQSPRHVVLRNYEGVITTYTEPEDYHEECDCEDCRVDKHREGVAALSGGQQLALEPPDLARKKRKFDKN

SEQ ID NO: 2557 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaagagcgataagaactaa

SEQ ID NO: 2558 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKGLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKKRKSDKN

SEQ ID NO: 2559 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgcccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaagtttgcgcggacacacctcgggctatgcagttcctacctttgtggtacatgctccggggggtggtggtaagatacctgtaacgccgaactatgttgtatctcagtccccacgacgtgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaaaaacgcaagagcgataagaactaa

SEQ ID NO: 2560 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPISKGIEIIESLRGHTSGYAVPTFVVHAPGGGGKIPVTPNYVVSQSPRRVVLRNYEGVITTYTEPEDYHEECDCEDCRADKHREGVAALSGGQQLALEPPDLARKKRKSDKN

SEQ ID NO: 2561 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagagcgataagaactaa

SEQ ID NO: 2562 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHKEGVAALSGGQQLALEPPDLARKKRKSDKN

SEQ ID NO: 2563 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaggttcgataagaactaa

SEQ ID NO: 2564 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRADKHKEGVAALSGGQQLALEPPDLARKKRRFDKN

SEQ ID NO: 2565 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggcctatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaaggtccctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaggagcgataagaactaa

SEQ ID NO: 2566 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMAYAGIPLGNQTVLLRGINDCTHVMKRLVHLLVKIRVRPYYIYACDLSLGIGHFRTPVSKGIEIIESLRGHTSGYAVPTFVVHAPGGGGKVPVTPNYVVSQSPRHVVLRNYEGVITTYTEPEDYHEECDCEDCRADKHKEGVAALSGGQQLALEPPDLARKKRRSDKN

SEQ ID NO: 2567 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggagaactatcatgaggagtgcgattgtgaggactgccgagccgacaagcataaagagggcgtggctgcactttccggaggtcagcagttggctttagagcctcccgacttagctcgcaaaaaacgcaggttcgataagaactaa

SEQ ID NO: 2568 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIENLRGHTSGYAVPTFVVHAPGGGGKVPIAPNYVVSQSPRHVVLRNYEGVITTYTEPENYHEECDCEDCRADKHKEGVAALSGGQQLALEPPDLARKKRRFDKN

SEQ ID NO: 2569 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctataacgccgaactatgttgtatctcagtccccacgacatgtggttcttcgcaattatgaaggtgttatcacaacctatacggagccggagaactatcatgaggagtgcgattgtgaggactgccgagtcgacaagcataaagagggcgtggctgcactttccggaggtcagcagttggctttagagcctcccgacttagctcgcaaaaaacgcaagtttgataagaactaa

SEQ ID NO: 2570 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEIIESLRGHTSGYAVPTFVVHAPGGGGKIPITPNYVVSQSPRHVVLRNYEGVITTYTEPENYHEECDCEDCRVDKHKEGVAALSGGQQLALEPPDLARKKRKFDKN

SEQ ID NO: 2571 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctttgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaggagcgataagaactaa

SEQ ID NO: 2572 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPLTPNYVVSQSPRHVVLRNYEGVITTYTEPEDYHEECDCEDCRADKHKEGVAALSGGQQLALEPPDLARKKRRSDKN

SEQ ID NO: 2573 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctttgacgccgaactatgttgtatctcagtccccacgacatgtggttcttcgcaattatgaaggtgttatcacaacctatacggagccggagaactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2574 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIENLRGHTSGYAVPTFVVHAPGGGGKIPLTPNYVVSQSPRHVVLRNYEGVITTYTEPENYHEECDCEDCRADKHKEGVAALSGGQQLALEPPDLARKKRKFDKN

SEQ ID NO: 2575 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaactatcatgaggagtgcgattgtgaggactgccgagccgacaagcataaagagggcgtggctgcactttccggaggtcagcagttggctttagagcctcccgacttagctcgcaaaaaacgcaggctcgataagaactaa

SEQ ID NO: 2576 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKGLVHLLVKIRVRPYYIYACDLSLGIGHFRTPVSKGIEITENLRGHTSGYAVPTFVVHAPGGGGKIPVTPNYVVSQSPRHVVLRNYEGVITTYTEPENYHEECDCEDCRADKHKEGVAALSGGQQLALEPPDLARKKRRLDKN

SEQ ID NO: 2577 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 2578 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 2579 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacaggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctataacgccgaactatgttgtatctcagtccccacgacgtgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagagcgataagaactaa

SEQ ID NO: 2580 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKGLVHLLVKIRVRPYYIYACDLSLGIGHFRTPVSKGIEIIESLRGHTSGYAVPTFVVHAPGGGGKIPITPNYVVSQSPRRVVLRNYEGVITTYTEPEDYHEECDCEDCRADKHKEGVAALSGGQQLALEPPDLARKKRKSDKN

SEQ ID NO: 2581 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgcacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggagaactatcatgaggagtgcgattgtgaggactgccgagccgacaagcataaagaaggcgtggctgcactttccggaggtcagcagttggctttagagcctcccgacttagctcgcaaaaaacgcaggttcgataagaactaa

SEQ ID NO: 2582 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPENYHEECDCEDCRADKHKEGVAALSGGQQLALEPPDLARKKRRFDKN

SEQ ID NO: 2583 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaagctcgataagaactaa

SEQ ID NO: 2584 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKGLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKKRKLDKN

SEQ ID NO: 2585 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggagaactatcatgaggagtgcgattgtgaggactgccgagtcgacaagcatcgtgagggcgtggctgcactttccggaggtcagcagttggctttagagcctcccgacttagctcgcaaaaaacgcaagttcgataagaactaa

SEQ ID NO: 2586 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIESLRGHTSGYAVPTFVVHAPGGGGKIPLAPNYVVSQSPRHVVLRNYEGVITTYTEPENYHEECDCEDCRVDKHREGVAALSGGQQLALEPPDLARKKRKFDKN

SEQ ID NO: 2587 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaactatcatgaggagtgcgattgtgaggactgccgagccgacaagcataaagagggcgtggctgcactttccggaggtcagcagttggctttagagcctcccgacttagctcgcaaaaaacgcaagagcgataagaactaa

SEQ ID NO: 2588 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEITENLRGHTSGYAVPTFVVHAPGGGGKIPVTPNYVVSQSPRHVVLRNYEGVITTYTEPENYHEECDCEDCRADKHKEGVAALSGGQQLALEPPDLARKKRKSDKN

SEQ ID NO: 2589 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaagtttgcgcggacacacctcgggctatgcagttcctacctttgtggtacatgctccggggggtggtggtaagatacctttggcgccgaactatgttgtatctcagtccccacgacgtgtggttcttcgcaattatgaaggtgttatcacaacctatacggagccggaggactatcatgaggagtgcgattgtgaggactgccgagccgacaagcatcgtgagggcgtggctgcactttccgaaggtcagcagttggctttagagcctcccgacttagctcgcaaaaaacgcaggagcgataagaactaa

SEQ ID NO: 2590 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEITESLRGHTSGYAVPTFVVHAPGGGGKIPLAPNYVVSQSPRRVVLRNYEGVITTYTEPEDYHEECDCEDCRADKHREGVAALSEGQQLALEPPDLARKKRRSDKN

SEQ ID NO: 2591 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggcctatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaagtttgcgcggacacacctcgggctatgcagttcctacctttgtggtacatgctccggggggtggtggtaagatacctatagcgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaggagcgataagaactaa

SEQ ID NO: 2592 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMAYAGIPLGNQTVLLRGINDCTHVMKRLVHLLVKIRVRPYYIYACDLSLGIGHFRTPVSKGIEITESLRGHTSGYAVPTFVVHAPGGGGKIPIAPNYVVSQSPRHVVLRNYEGVITTYTEPEDYHEECDCEDCRADKHKEGVAALSGGQQLALEPPDLARKKRRSDKN

SEQ ID NO: 2593 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattaaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtaacgccgaactatgttgtatctcagtccccacgacgtgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2594 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIENLRGHTSGYAVPTFVVHAPGGGGKVPVTPNYVVSQSPRRVVLRNYEGVITTYTEPEDYHEECDCEDCRADKHKEGVAALSGGQQLALEPPDLARKKRKFDKN

SEQ ID NO: 2595 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaaaaacgcaagtttgataagaactaa

SEQ ID NO: 2596 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIESLRGHTSGYAVPTFVVHAPGGGGKIPVTPNYVVSQSPRHVVLRNYEGVITTYTEPEDYHEECDCEDCRADKHREGVAALSGGQQLALEPPDLARKKRKFDKN

SEQ ID NO: 2597 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggcctatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaaggtccctgtagcgccgaactatgttgtatctcagtccccacgacgtgtggttcttcgcaattatgaaggtgttatcacaacctatacggagccggagaactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2598 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMAYAGIPLGNQTVLLRGINDCTHVMKRLVHLLVKIRVRPYYIYACDLSLGIGHFRTPVSKGIEIIESLRGHTSGYAVPTFVVHAPGGGGKVPVAPNYVVSQSPRRVVLRNYEGVITTYTEPENYHEECDCEDCRADKHKEGVAALSGGQQLALEPPDLARKKRKFDKN

SEQ ID NO: 2599 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaaggtccctatagcgccgaactatgttgtatctcagtccccacgacgtgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaaaaacgcaagtttgataagaactaa

SEQ ID NO: 2600 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKGLVHLLVKIRVRPYYIYACDLSLGIGHFRTPVSKGIEIIESLRGHTSGYAVPTFVVHAPGGGGKVPIAPNYVVSQSPRRVVLRNYEGVITTYTEPEDYHEECDCEDCRADKHREGVAALSGGQQLALEPPDLARKKRKFDKN

SEQ ID NO: 2601 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgccagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggagaactatcatgaggagtgcgattgtgaggactgccgagccgacaagcataaagagggcgtggctgcactttccgaaggtcagcagttggctttagagcctcccgacttagctcgcaaaaaacgcaagagcgataagaactaa

SEQ ID NO: 2602 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRRELVRAPEDMVDPLSEDEDSPVPGLTHRYPDRVLFLITDKCSMYCRHCTRRRFAGQKDASSPSERIDRCIEYIANTPTVRDVLLSGGDALLASDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIENLRGHTSGYAVPTFVVHAPGGGGKIPLAPNYVVSQSPRHVVLRNYEGVITTYTEPENYHEECDCEDCRADKHKEGVAALSEGQQLALEPPDLARKKRKSDKN

SEQ ID NO: 2603 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaatcaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccatccctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattaccgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggagaactatcatgaggagtgcgattgtgaggactgccgagtcgacaagcatcgtgagggcgtggctgcactttccggaggtcagcagttggctttagagcctcccgacttagctcgcaaaaaacgcaagtttgataagaactaa

SEQ ID NO: 2604 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKGLVHLLVKIRVRPYYIYACDLSLGIGHFRTPVSKGIEITESLRGHTSGYAVPTFVVHAPGGGGKIPVAPNYVVSQSPRHVVLRNYEGVITTYTEPENYHEECDCEDCRVDKHREGVAALSGGQQLALEPPDLARKKRKFDKN

SEQ ID NO: 2605 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaaaaacgcaagtttgataagaactaa

SEQ ID NO: 2606 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKGLVHLLVKIRVRPYYIYACDLSLGIGHFRTPVSKGIEIIESLRGHTSGYAVPTFVVHAPGGGGKIPVTPNYVVSQSPRHVVLRNYEGVITTYTEPEDYHEECDCEDCRVDKHKEGVAALSGGQQLALEPPDLARKKRKFDKN

SEQ ID NO: 2607 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggcggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctgtaacgccgaactatgttgtatctcagtccccacgacgtgtggttcttcgcaattatgaaggtgttatcacaacctatacggagccggagaactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2608 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLADMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIESLRGHTSGYAVPTFVVHAPGGGGKIPVTPNYVVSQSPRRVVLRNYEGVITTYTEPENYHEECDCEDCRADKHKEGVAALSGGQQLALEPPDLARKKRKFDKN

SEQ ID NO: 2609 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctttggcgccgaactatgttgtatctcagtccccacgacgtgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaagtttgataagaactaa

SEQ ID NO: 2610 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIESLRGHTSGYAVPTFVVHAPGGGGKIPLAPNYVVSQSPRRVVLRNYEGVITTYTEPEDYHEECDCEDCRVDKHREGVAALSGGQQLALEPPDLARKKRKFDKN

SEQ ID NO: 2611 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggcctatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2612 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMAYAGIPLGNQTVLLRGINDCTHVMKGLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2613 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagatacgtgtgcgtccttactatatatatgcttgcgatctttcgcttggaatagggcatttccgcacgccggtatctaaaggaatcgaaattaccgaaagtttgcgcggacacacctcgggctatgcggttcctacctttgtggtacatgctccggggggtggtggtaaggtccctttggcgccgaactatgttgtatctcagtccccacgacatgtggttcttcgcaattatgaaggtgttatcacaacctatacggagccggaggtctatcatgaggagtgcgattgtgaggactgccgagtcgacaagcataaagagggcgtggctgcactttccggaggtcagcagttggctttagagcctcccgacttagctcgcaaaaaacgcaagtttgataagaactaa

SEQ ID NO: 2614 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEITESLRGHTSGYAVPTFVVHAPGGGGKVPLAPNYVVSQSPRHVVLRNYEGVITTYTEPEVYHEECDCEDCRVDKHKEGVAALSGGQQLALEPPDLARKKRKFDKN

SEQ ID NO: 2615 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaaggtccctgtagcgccgaactatgttgtatctcagtccccacgacgtgtggttcttcgcaattatgaaggtgttatcacaacctatacggagccggagaactatcatgaggagtgcgattgtgaggactgccgagccgacaagcatcgtgagggcgtggctgcactttccgaaggtcagcagttggctttagagcctcccgacttagctcgcaaaaaacgcaagtttgataagaactaa

SEQ ID NO: 2616 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIESLRGHTSGYAVPTFVVHAPGGGGKVPVAPNYVVSQSPRRVVLRNYEGVITTYTEPENYHEECDCEDCRADKHREGVAALSEGQQLALEPPDLARKKRKFDKN

SEQ ID NO: 2617 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctcccccagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttgacgccgaactatgttgtatctcagtccccacgacatgtggttcttcgcaattatgaaggtgttatcacaacctatacggagccggagaactatcatgaggagtgcgattgtgaggactgccgagccgacaagcataaagagggcgtggctgcactttccgaaggtcagcagttggctttagagcctcccgacttagctcgcaaaaaacgcaagagcgataagaactaa

SEQ ID NO: 2618 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIENLRGHTSGYAVPTFVVHAPGGGGKVPLTPNYVVSQSPRHVVLRNYEGVITTYTEPENYHEECDCEDCRADKHKEGVAALSEGQQLALEPPDLARKKRKSDKN

SEQ ID NO: 2619 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaaggtccctttggcgccgaactatgttgtatctcagtccccacgacgtgtggttcttcgcaattatgaaggtgttatcacaacctatacggagccggagaactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2620 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEIIESLRGHTSGYAVPTFVVHAPGGGGKVPLAPNYVVSQSPRRVVLRNYEGVITTYTEPENYHEECDCEDCRADKHKEGVAALSGGQQLALEPPDLARKKRKFDKN

SEQ ID NO: 2621 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggaggtaagatacctatagcgccgaactatgttgtatctcagtccccacgacgtgtggttcttcgcaattatgaaggtgttatcacaacctatacggagccggaggactatcatgaggagtgcgattgtgaggactgccgagtcgacaagcataaagagggcgtggctgcactttccgaaggtcagcagttggctttagagcctcccgacttagctcgcaaaaaacgcaagtttgataagaactaa

SEQ ID NO: 2622 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIENLRGHTSGYAVPTFVVHAPGGGGKIPIAPNYVVSQSPRRVVLRNYEGVITTYTEPEDYHEECDCEDCRVDKHKEGVAALSEGQQLALEPPDLARKKRKFDKN

SEQ ID NO: 2623 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccgaaggtcagcagttggctttagagcctcccgacttagctcgtaaaaaacgcaggttcgataagaactaa

SEQ ID NO: 2624 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRADKHKEGVAALSEGQQLALEPPDLARKKRRFDKN

SEQ ID NO: 2625 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctatagcgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaggagcgataagaactaa

SEQ ID NO: 2626 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKGLVHLLVKIRVRPYYIYACDLSLGIGHFRTPVSKGIEIIENLRGHTSGYAVPTFVVHAPGGGGKIPIAPNYVVSQSPRHVVLRNYEGVITTYTEPEDYHEECDCEDCRADKHKEGVAALSGGQQLALEPPDLARKKRRSDKN

SEQ ID NO: 2627 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctatagcgccgaactatgttgtatctcagtccccacgacatgtggttcttcgcaattatgaaggtgttatcacaacctatacggagccggagaactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2628 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEIIESLRGHTSGYAVPTFVVHAPGGGGKIPIAPNYVVSQSPRHVVLRNYEGVITTYTEPENYHEECDCEDCRADKHKEGVAALSGGQQLALEPPDLARKKRKFDKN

SEQ ID NO: 2629 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattaccgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2630 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTKQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEITESLRGHTSGYAVPTFVVHAPGGGGKIPVAPNYVVSQSPRHVVLRNYEGVITTYTEPEDYHEECDCEDCRADKHKEGVAALSGGQQLALEPPDLARKKRKFDKN

SEQ ID NO: 2631 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggagaactatcatgaggagtgcgattgtgaggactgccgagccgacaagcataaagagggcgtggctgcactttccgaaggtcagcagttggctttagagcctcccgacttagctcgcaaaaaacgcaggctcgataagaactaa

SEQ ID NO: 2632 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTKQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEIIENLRGHTSGYAVPTFVVHAPGGGGKIPLAPNYVVSQSPRHVVLRNYEGVITTYTEPENYHEECDCEDCRADKHKEGVAALSEGQQLALEPPDLARKKRRLDKN

SEQ ID NO: 2633 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgtcggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaaaaacgcaagtttgataagaactaa

SEQ ID NO: 2634 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRASVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIESLRGHTSGYAVPTFVVHAPGGGGKIPVTPNYVVSQSPRHVVLRNYEGVITTYTEPEDYHEECDCEDCRADKHREGVAALSGGQQLALEPPDLARKKRKFDKN

SEQ ID NO: 2635 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaggattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaaggtccctatagcgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaggttcgataagaactaa

SEQ ID NO: 2636 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIESLRGHTSGYAVPTFVVHAPGGGGKVPIAPNYVVSQSPRHVVLRNYEGVITTYTEPEDYHEECDCEDCRADKHKEGVAALSGGQQLALEPPDLARKKRRFDKN

SEQ ID NO: 2637 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaaaaacgcaggagcgataagaactaa

SEQ ID NO: 2638 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKGLVHLLVKIRVRPYYIYACDLSLGIGHFRTPVSKGIEIIENLRGHTSGYAVPTFVVHAPGGGGKIPLAPNYVVSQSPRHVVLRNYEGVITTYTEPEDYHEECDCEDCRADKHREGVAALSGGQQLALEPPDLARKKRRSDKN

SEQ ID NO: 2639 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggctcgataagaactaa

SEQ ID NO: 2640 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEITESLRGHTSGYAVPTFVVHAPGGGGKIPLAPNYVVSQSPRHVVLRNYEGVITTYTEPEDYHEECDCEDCRVDKHREGVAALSGGQQLALEPPDLARKKRRLDKN

SEQ ID NO: 2641 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctttggcgccgaactatgtggtatctcagtccccacgacatgtggttcttcgcaattatgaaggtgttatcacaacctatacggagccggagaactatcatgaggagtgcgattgtgaggactgccgagtcgacaagcataaagagggcgtggctgcactttccggaggtcagcagttggctttagagcctcccgacttagctcgcaaaaaacgcaagctcgataagaactaa

SEQ ID NO: 2642 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIENLRGHTSGYAVPTFVVHAPGGGGKIPLAPNYVVSQSPRHVVLRNYEGVITTYTEPENYHEECDCEDCRVDKHKEGVAALSGGQQLALEPPDLARKKRKLDKN

SEQ ID NO: 2643 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagaactatcatgaggagtgcgattgtgaggactgccgagccgacaagcataaagagggcgtggctgcactttccggaggtcagcagttggctttagagcctcccgacttagctcgcaaaaaacgcaagctcgataagaactaa

SEQ ID NO: 2644 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKGLVHLLVKIRVRPYYIYACDLSLGIGHFRTPVSKGIEIIESLRGHTSGYAVPTFVVHAPGGGGKIPVTPNYVVSQSPRHVVLRNYEGVITTYTEPENYHEECDCEDCRADKHKEGVAALSGGQQLALEPPDLARKKRKLDKN

SEQ ID NO: 2645 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtaacgccgaactatgttgtatctcagtccccacgacatgtggttcttcgcaattatgaaggtgttatcacaacctatacggagccggagaactatcatgaggagtgcgattgtgaggactgccgagccgacaagcataaagagggcgtggctgcactttccgaaggtcagcagttggctttagagcctcccgacttagctcgcaaaaaacgcaggttcgataagaactaa

SEQ ID NO: 2646 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEIIENLRGHTSGYAVPTFVVHAPGGGGKVPVTPNYVVSQSPRHVVLRNYEGVITTYTEPENYHEECDCEDCRADKHKEGVAALSEGQQLALEPPDLARKKRRFDKN

SEQ ID NO: 2647 - DNA, 1251 bp, Artificial Sequence
  Description of Artificial Sequence: Synthetic Construct
atggcagaaagtcgtagagagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccgaagtactccgaatggctatcacaccttattatttgagtttaatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2648 - protein, 416 aa, Artificial Sequence
  Description of Artificial Sequence: Synthetic Construct
MAESRREYYFPDVTDEQWYDWHWQVINRIKTLDQLEKYVTLTAEEEEGVKESPEVLRMAITPYYLSLIDPENPNCPIRKQAIPTQQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPLAPNYVVSQSPRHVVLRNYEGVITTYTEPEDYHEECDCEDCRADKHKEGVAALSGGQQLALEPPDLARKKRKFDKN

SEQ ID NO: 2649 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggcctatgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggttcatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaaaaacgcaggttcgataagaactaa

SEQ ID NO: 2650 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMAYAGIPLGNQTVLLRGINDCTHVMKGLVHLLVKIRVRPYYIYACDLSLGIGHFRTPVSKGIEIIESLRGHTSGYAVPTFVVHAPGGGGKIPVTPNYVVSQSPRHVVLRNYEGVITTYTEPEDYHEECDCEDCRADKHREGVAALSGGQQLALEPPDLARKKRRFDKN

SEQ ID NO: 2651 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctttgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2652 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEIIENLRGHTSGYAVPTFVVHAPGGGGKVPLTPNYVVSQSPRHVVLRNYEGVITTYTEPEDYHEECDCEDCRADKHKEGVAALSGGQQLALEPPDLARKKRKFDKN

SEQ ID NO: 2653 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccctattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatctccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacgtgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagcgcgcaaaaaacgcaagttcgataagaactaa

SEQ ID NO: 2654 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHLRTPVSKGIEIIENLRGHTSGYAVPTFVVHAPGGGGKIPVTPNYVVSQSPRRVVLRNYEGVITTYTEPEDYHEECDCEDCRVDKHKEGVAALSGGQQLALEPPDLARKKRKFDKN

SEQ ID NO: 2655 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctttggcgccgaactatgttgtatctcagtccccacgacgtgtggttcttcgcaattatgaaggtgttatcacaacctatacggagccggagaactatcatgaggagtgcgattgtgaggactgccgagtcgacaagcataaagagggcgtggctgcactttccgaaggtcagcagttggctttagagcctcccgacttagctcgcaaaaaacgcaggagcgataagaactaa

SEQ ID NO: 2656 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIENLRGHTSGYAVPTFVVHAPGGGGKIPLAPNYVVSQSPRRVVLRNYEGVITTYTEPENYHEECDCEDCRVDKHKEGVAALSEGQQLALEPPDLARKKRRSDKN

SEQ ID NO: 2657 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgccccatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattaccgaaagtttgcgcggacacacctcgggctatgcagttcctacctttgtggtacatgctccggggggtggtggtaaggtccctttgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2658 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLPHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEITESLRGHTSGYAVPTFVVHAPGGGGKVPLTPNYVVSQSPRHVVLRNYEGVITTYTEPEDYHEECDCEDCRADKHKEGVAALSGGQQLALEPPDLARKKRKFDKN

SEQ ID NO: 2659 - DNA, 1251 bp, Artificial Sequence
  Description of Artificial Sequence: Synthetic Construct
atggcagaaagtcgtagaaagtattatttccctcatgtcaacgatgagcaatggtacgactggcattggcaggccatcaatcgaattaagacgctcgaccagctggagaagtacgttacactcaccgctgaagaagaagagggagtacaagaatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattaccgaaagtttgcgcggacacacctcgggctatgcagttcctacctttgtggtacatgctccggggggtggtggtaagatacctttgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcatggctgcactttccgaaggtcagcagttggctttagagcctcccgacttagctcgcaaaaaacgcaagtttgataagaactaa

SEQ ID NO: 2660 - protein, 416 aa, Artificial Sequence
  Description of Artificial Sequence: Synthetic Construct
MAESRRKYYFPHVNDEQWYDWHWQAINRIKTLDQLEKYVTLTAEEEEGVQESPKVLRMAITPYYLSLIDPENPNCPIRKQAIPTRQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEITESLRGHTSGYAVPTFVVHAPGGGGKIPLTPNYVVSQSPRHVVLRNYEGVITTYTEPEDYHEECDCEDCRADKHKEGMAALSEGQQLALEPPDLARKKRKFDKN

SEQ ID NO: 2661 - DNA, 1251 bp, Artificial Sequence
  Description of Artificial Sequence: Synthetic Construct
atggcagaaagtcgtataaagtattatttccctgatgtcaccgatgagcaatggtacgactggcattggcaggtcatcaatcgaattaatacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgccccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgcggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaagtttgcgcggacacacctcgggctatgcagttcctacctttgtggtacatgctccggggggtggtggtaagatacctgtaacgccgaactatgttgtatctcagtccccacgacgtgtggttcttcgcaattatgaaggtgttatcacaacctatacggagccggagaactatcatgaggagtgcgattgtgaggactgccgagccgacaagcataaagagggcgtggctgcactttccgaaggtcagcagttggctttagagcctcccgacttagctcgcaaaaaacgcaagagcgataagaactaa

SEQ ID NO: 2662 - protein, 416 aa, Artificial Sequence
  Description of Artificial Sequence: Synthetic Construct
MAESRIKYYFPDVTDEQWYDWHWQVINRINTLDQLEKYVTLTAEEEEGVKESPKVLRMAITPYYLSLIDPENPNCPIRKQAIPTKRELVRAPEDMVDPLSEDEDSPVPGLPHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVRLNTHFNHPNEVTEEAVEACERMANAGIPLGNQTVLLRGINDCTHVMKRLVHLLVKIRVRPYYIYACDLSLGIGHFRTPVSKGIEITESLRGHTSGYAVPTFVVHAPGGGGKIPVTPNYVVSQSPRRVVLRNYEGVITTYTEPENYHEECDCEDCRADKHKEGVAALSEGQQLALEPPDLARKKRKSDKN

SEQ ID NO: 2663 - DNA, 1251 bp, Artificial Sequence
  Description of Artificial Sequence: Synthetic Construct
atggcagaaagtcgtagaaagtattatttccctcatgtcaccgatgagcaatggtacgactggcattggcaggccctcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacaggaactggtacgtgctcctgaagatatggtagacccacttagtgaagatgaagattcgcccgtacccggactgccccatcgttatccggatcgtgtattgttccttatcacggacgaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagataccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctgtaacgccgaactatgttgtatctcagtccccacgacgtgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaaaaacgcaagtttgataagaactaa

SEQ ID NO: 2664 - protein, 416 aa, Artificial Sequence
  Description of Artificial Sequence: Synthetic Construct
MAESRRKYYFPHVTDEQWYDWHWQALNRIKTLDQLEKYVTLTAEEEEGVKGSPKVLRMAITPYYLSLIDPENPNCPIRKQAIPTRQELVRAPEDMVDPLSEDEDSPVPGLPHRYPDRVLFLITDECSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEDTEEAVEACERMASAGIPLGNQTVLLRGINDCTHVMKGLVHLLVKIRVRPYYIYACDLSLGIGHFRTPVSKGIEIIESLRGHTSGYAVPTFVVHAPGGGGKIPVTPNYVVSQSPRRVVLRNYEGVITTYTEPEDYHEECDCEDCRVDKHKEGVAALSGGQQLALEPPDLARKKRKFDKN

SEQ ID NO: 2665 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactaaacgggaactggtacgtgctcctgaagatatggtaggcccacttaatgaagaggaagattcaccggtacccagactcccccatctttatccggatcgtgtattgttccttatcacggacaaatgttcgatgtactgtcgtcattgtactcaccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctttggcgccgaactatgttgtatctcagtccccacgacgtgtggttcttcgcaattatgaaggtgttatcacaacctatacggagccggagaactatcatgaggagtgcgattgtgaggactgccgagccgacaagcatcgtgagggcgtggctgcactttccggaggtcagcagttggctttagagcctcccgacttagctcgcaaaaaacgcaagtttgataagaactaa

SEQ ID NO: 2666 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTKRELVRAPEDMVGPLNEEEDSPVPRLPHLYPDRVLFLITDKCSMYCRHCTHRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEITENLRGHTSGYAVPTFVVHAPGGGGKIPLAPNYVVSQSPRRVVLRNYEGVITTYTEPENYHEECDCEDCRADKHREGVAALSGGQQLALEPPDLARKKRKFDKN

SEQ ID NO: 2667 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcggtgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacgtttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctataacgccgaactatgttgtatctcagtccccacgacgtgtggttcttcgcaattatgaaggtgttatcacaacctatacggagccggagaactatcatgaggagtgcgattgtgaggactgccgagccgacaagcataaagagggcgtggctgcactttccggaggtcagcagttggctttagagcctcccgacttagctcgcaaaaaacgcaagagcgataagaactaa

SEQ ID NO: 2668 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQRDASSPSERIDRCIEYIANTPTVRDVLLSGGGALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVRLLVKIRVRPYYIYACDLSLGIGHFRTPVSKGIEIIENLRGHTSGYAVPTFVVHAPGGGGKVPITPNYVVSQSPRRVVLRNYEGVITTYTEPENYHEECDCEDCRADKHKEGVAALSGGQQLALEPPDLARKKRKSDKN

SEQ ID NO: 2669 - DNA, 1251 bp, Artificial Sequence
  Description of Artificial Sequence: Synthetic Construct
atggcagaaagtcgtagaaagtattatttcccccatttaaacgatgagcaatggtacgactggcattggcaggccttcaaacgaattaagacgctcgaccagctggagaagtacgttacactcaccgctgaagaagaagagggagtaccaggatcgcccaaagtactccgaatggctatcacaccttattatttgagtttgatagaccccgagaatcctaattgtccgattcgtaaacaagccattcctactcgacaggaactggtacgtgctcctgaagatgtggtagacccacttaatgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaaggtccctgtaacgccgaactatgttgtatctcagtccccacgacgtgtggttcttcgcaattatgaaggtgttatcacaacctatacggagccggaggactaccatgaggagtgcgattgtgaggactgccgagtcgacaagcatcgtaagggcgtggctgcactttccggaggtcagcagttggctttagagcctcccgacttagctcgcaaaaaacgcaagagcgataagaactaa

SEQ ID NO: 2670 - protein, 416 aa, Artificial Sequence
  Description of Artificial Sequence: Synthetic Construct
MAESRRKYYFPHLNDEQWYDWHWQAFKRIKTLDQLEKYVTLTAEEEEGVPGSPKVLRMAITPYYLSLIDPENPNCPIRKQAIPTRQELVRAPEDVVDPLNEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEIIENLRGHTSGYAVPTFVVHAPGGGGKVPVTPNYVVSQSPRRVVLRNYEGVITTYTEPEDYHEECDCEDCRVDKHRKGVAALSGGQQLALEPPDLARKKRKSDKN

SEQ ID NO: 2671 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggagaactatcatgaggagtgcgattgtgaggactgccgagtcgacaagcataaagagggcgtggctgcactttccggaggtcagcagttggctttagagcctcccgacttagctcgcaaaaaacgcaggagcgataagaactaa

SEQ ID NO: 2672 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKGLVHLLVKIRVRPYYIYACDLSLGIGHFRTPVSKGIEIIESLRGHTSGYAVPTFVVHAPGGGGKIPLAPNYVVSQSPRHVVLRNYEGVITTYTEPENYHEECDCEDCRVDKHKEGVAALSGGQQLALEPPDLARKKRRSDKN

SEQ ID NO: 2673 - DNA, 1251 bp, Artificial Sequence
  Description of Artificial Sequence: Synthetic Construct
atggcagaaagtcgtagaaagtattatttccctgatgtcacagatgagcaatggtacgactggcattggcaggtcatcaatcgaattaagacgctcgaccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgccccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagttcgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaataccggtattccgttgggtaaccaaacggttttattgcgtggaatcaatgattgtacacatgtgatgaagggattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctatagcgccgaactatgttgtatctcagtccccacgacgtgtggttcttcgcaattatgaaggtgttatcacaacctatacggagccggagaactatcatgaggagtgcgattgtgaggactgccgagccgacaagcataaagagggcgtggctgcactttccggaggtcagcagttggctttagagcctcccgacttagctcgcaaaaaacgcaagctcgataagaactaa

SEQ ID NO: 2674 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKGSPKVLRMAITPYYLSLIDPENPNCPIRKQAIPTRRELVRAPEDMVDPLSEDEDSPVPGLPHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANTGIPLGNQTVLLRGINDCTHVMKGLVHLLVKIRVRPYYIYACDLSLGIGHFRTPVSKGIEIIESLRGHTSGYAVPTFVVHAPGGGGKIPIAPNYVVSQSPRRVVLRNYEGVITTYTEPENYHEECDCEDCRADKHKEGVAALSGGQQLALEPPDLARKKRKLDKN

SEQ ID NO: 2675 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccagagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgcgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacgacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2676 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPRVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2677 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgacagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2678 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLTDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2679 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtgcctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2680 - protein, 416 aa, Artificial Sequence; identical to SEQ ID NO: 2052
  Description of Artificial Sequence: Synthetic Construct

SEQ ID NO: 2681 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatcttgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2682 - protein, 416 aa, Artificial Sequence; identical to SEQ ID NO: 2052
  Description of Artificial Sequence: Synthetic Construct

SEQ ID NO: 2683 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggtgatgccctcctcgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacgacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2684 - protein, 416 aa, Artificial Sequence; identical to SEQ ID NO: 2052
  Description of Artificial Sequence: Synthetic Construct

SEQ ID NO: 2685 - DNA, 1251 bp, Artificial Sequence
  Description of Artificial Sequence: Synthetic Construct
atggcagaaagtcgtagaaagtattatttcccccatatcaacgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaggccattcctactcaacaggaactggtacgtgctcctgaagatatggtagacccacttagtgaagatgaagattcgcccgtacccggactgactcatcgttacccggatcgtgtattgctccttatcacggacaaatgttcgatgtactgtcgtcattgtactcgccgtcgcttcgcaggacagaaagacgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaagcgcaagttcgataagaactaa

SEQ ID NO: 2686 - protein, 416 aa, Artificial Sequence
  Description of Artificial Sequence: Synthetic Construct
MAESRRKYYFPHINDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLLLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2687 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2688 - protein, 416 aa, Artificial Sequence; identical to SEQ ID NO: 2052
  Description of Artificial Sequence: Synthetic Construct

SEQ ID NO: 2689 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggagtaaaagaatcgcccaaagtactccgaatggctatcacaccttattatttgagcttgatagaccctgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttttccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctacacggagccggaggactatcatgaggagtgcgattgtgaggactgccgagccgacaagcataaagagggcgtggctgcactttccggaggtcagcagttggctttagagcctcctgacttagctcgcaaaaaacgcaagtttgataagaactaa

SEQ ID NO: 2690 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASFPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2691 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggggtaaaagaatcgcccaaagtactccgaatggctatcacaccttattatttgagtttgatagaccccgagaatcctaactgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaagcgcaagtttgataagaactaa

SEQ ID NO: 2692 - protein, 416 aa, Artificial Sequence; identical to SEQ ID NO: 2052
  Description of Artificial Sequence: Synthetic Construct

SEQ ID NO: 2693 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaggctattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcaggacagaaagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcagttggtggatatgctcaaaaaatatcatccggtgtggctgaacactcacttcaaccacccgaatgaggttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2694 - protein, 416 aa, Artificial Sequence; identical to SEQ ID NO: 2052
  Description of Artificial Sequence: Synthetic Construct

SEQ ID NO: 2695 - DNA, 1251 bp, Artificial Sequence
  Description of Artificial Sequence: Synthetic Construct
atggcagaaagtcgtagaaagtatcatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacgcctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaagcgcaagtttgataagaactaa

SEQ ID NO: 2696 - protein, 416 aa, Artificial Sequence
  Description of Artificial Sequence: Synthetic Construct
MAESRRKYHFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHASGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2697 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgtcgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2698 - protein, 416 aa, Artificial Sequence; identical to SEQ ID NO: 2052
  Description of Artificial Sequence: Synthetic Construct

SEQ ID NO: 2699 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcgggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaaaggagtcgaaattatcgaaaatttgcgcggacacacctcgggctatgcagttcctacctttgtggtacatgctccggggggtggtggtaagatacctgtaacgccgaacaatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2700 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGVEIIENLRGHTSGYAVPTFVVHAPGGGGKIPVTPNNVVSQSPRHVVLRNYEGVITTYTEPEDYHEECDCEDCRADKHKEGVAALSGGQQLALEPPDLARKKRKFDKN

SEQ ID NO: 2701 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2702 - protein, 416 aa, Artificial Sequence; identical to SEQ ID NO: 2052
  Description of Artificial Sequence: Synthetic Construct

SEQ ID NO: 2703 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcgtgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2704 - protein, 416 aa, Artificial Sequence; identical to SEQ ID NO: 2052
  Description of Artificial Sequence: Synthetic Construct

SEQ ID NO: 2705 - DNA, 1251 bp, Artificial Sequence
  Description of Artificial Sequence: Synthetic Construct
atggcagaaagtcgtagaaagtattatttccctgatgccaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2706 - protein, 416 aa, Artificial Sequence
  Description of Artificial Sequence: Synthetic Construct
MAESRRKYYFPDATDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2707 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcctctccttctgagcgcatcgatcgatgcattgagtatatagccaatacaccgacagtccgcgatgttttgctatcgggaggtgatgccctcctcgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcgtgcgatctttcgcttggaataggacatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2708 - protein, 416 aa, Artificial Sequence; identical to SEQ ID NO: 2052
  Description of Artificial Sequence: Synthetic Construct

SEQ ID NO: 2709 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcgtgcgatctttcgcttggaatagggcatttccgcacgccggtatctaaaggaatcgaaattatcgaaaatttgcgcggacacacctcgggctatgctgttcctacctttgtggtacatgctccggggggtggtggtaaggtacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2710 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKVPVTPNYVVSQSPRHVVLRNYEGVITTYTEPEDYHEECDCEDCRADKHKEGVAALSGGQQLALEPPDLARKKRKFDKN

SEQ ID NO: 2711 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcctctccttctgagcgcatcgatcgatgcattgagtatatagccaatacaccgacagtccgcgatgttttgctatcgggaggcgatgccctccttgtcagcgacgaacgcttggaatacatcctgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgtcgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2712 - protein, 416 aa, Artificial Sequence; identical to SEQ ID NO: 2052
  Description of Artificial Sequence: Synthetic Construct

SEQ ID NO: 2713 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgtgtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaaaggaatcgaaattatcgaaaatttgcgcggacacacctcgggctatgcagttcctacctttgtggtacatgctccggggggtggtggtaagatacctgtaacgccgaactatgtcgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2714 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLCLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2715 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgcgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2716 - protein, 416 aa, Artificial Sequence; identical to SEQ ID NO: 2052
  Description of Artificial Sequence: Synthetic Construct

SEQ ID NO: 2717 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2718 - protein, 416 aa, Artificial Sequence; identical to SEQ ID NO: 2052
  Description of Artificial Sequence: Synthetic Construct

SEQ ID NO: 2719 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgtcatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2720 - protein, 416 aa, Artificial Sequence; identical to SEQ ID NO: 2052
  Description of Artificial Sequence: Synthetic Construct

SEQ ID NO: 2721 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcgggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagagctaa

SEQ ID NO: 2722 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKS

SEQ ID NO: 2723 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2724 - protein, 416 aa, Artificial Sequence; identical to SEQ ID NO: 2052
  Description of Artificial Sequence: Synthetic Construct

SEQ ID NO: 2725 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactatatatatgcttgcgatctttcgcttggaataggacatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacgacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2726 - protein, 416 aa, Artificial Sequence; identical to SEQ ID NO: 2052
  Description of Artificial Sequence: Synthetic Construct

SEQ ID NO: 2727 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattacgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2728 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2729 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgcgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2730 - protein, 416 aa, Artificial Sequence; identical to SEQ ID NO: 2052
  Description of Artificial Sequence: Synthetic Construct

SEQ ID NO: 2731 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcgtgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2732 - protein, 416 aa, Artificial Sequence; identical to SEQ ID NO: 2052
  Description of Artificial Sequence: Synthetic Construct

SEQ ID NO: 2733 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacgacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2734 - protein, 416 aa, Artificial Sequence; identical to SEQ ID NO: 2052
  Description of Artificial Sequence: Synthetic Construct

SEQ ID NO: 2735 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtacccgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2736 - protein, 416 aa, Artificial Sequence; identical to SEQ ID NO: 2052
  Description of Artificial Sequence: Synthetic Construct

SEQ ID NO: 2737 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgtgcgcatcgatcgatgcattgagtatatagccaatacaccaacagtccgcgatgttttgctatcgggaggcgatgccctccttgtcagcgacgaacgcttggaatacatcttgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggagggctatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2738 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSVRIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEGYHEECDCEDCRADKHKEGVAALSGGQQLALEPPDLARKKRKFDKN

SEQ ID NO: 2739 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatcttgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2740 - protein, 416 aa, Artificial Sequence; identical to SEQ ID NO: 2052
  Description of Artificial Sequence: Synthetic Construct

SEQ ID NO: 2741 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgcgtgcgtccttactatatatatgcttgcgatctttcgcttggaataggacatttccgcacgccggtatctaaaggaatcgaaattatcgaaaatttgcgcggacacacctcgggctatgctgttcctacctttgtggtacatgctccggggggtggtggtaaggtccctttggcgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagagcgataagaactaa

SEQ ID NO: 2742 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKVPLAPNYVVSQSPRHVVLRNYEGVITTYTEPEDYHEECDCEDCRADKHKEGVAALSGGQQLALEPPDLARKKRKSDKN

SEQ ID NO: 2743 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacgccttattatttgagtttggtagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcgtgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacgacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2744 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLVDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2745 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatcctgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaaaggaatcgaaattatcgaaaatttgcgcggacacacctcgggctatgcggttcctacctttgtggtacatgctccggggggtggtggtaagatacctgtgacgccgaactatgtcgtatctcagtccccacgacatgtggttcttcgcaattatgaaggtgttatcacgacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2746 - protein, 416 aa, Artificial Sequence; identical to SEQ ID NO: 2052
  Description of Artificial Sequence: Synthetic Construct

SEQ ID NO: 2747 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcgtgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2748 - protein, 416 aa, Artificial Sequence; identical to SEQ ID NO: 2052
  Description of Artificial Sequence: Synthetic Construct

SEQ ID NO: 2749 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcactgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacgacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2750 - protein, 416 aa, Artificial Sequence; identical to SEQ ID NO: 2052
  Description of Artificial Sequence: Synthetic Construct

SEQ ID NO: 2751 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtgaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgtcgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2752 - protein, 416 aa, Artificial Sequence; identical to SEQ ID NO: 2052
  Description of Artificial Sequence: Synthetic Construct

SEQ ID NO: 2753 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgcgtgcgtccttactatatatatgcttgcgatctttcgcttggaataggacatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2754 - protein, 416 aa, Artificial Sequence; identical to SEQ ID NO: 2052
  Description of Artificial Sequence: Synthetic Construct

SEQ ID NO: 2755 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcctctccttctgagcgcatcgatcgatgcattgagtatatagccaatacaccgacagtccgcgatgttttgctatcgggaggcgatgccctcctcgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgcgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2756 - protein, 416 aa, Artificial Sequence; identical to SEQ ID NO: 2052
  Description of Artificial Sequence: Synthetic Construct

SEQ ID NO: 2757 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacgacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2758 - protein, 416 aa, Artificial Sequence; identical to SEQ ID NO: 2052
  Description of Artificial Sequence: Synthetic Construct

SEQ ID NO: 2759 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaaccgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattggagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgcgtgcgtccttactatatatatgcttgcgatctttcgcttggaatagggcatttccgcacgccggtatctaaaggaatcgagattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2760 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILERLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2761 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtaacgccaaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2762 - protein, 416 aa, Artificial Sequence; identical to SEQ ID NO: 2052
  Description of Artificial Sequence: Synthetic Construct

SEQ ID NO: 2763 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcgtgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtggggactgccgagccgacaagcataaagagggcgtggctgcactttccggaggtcagcagttggctttagagcctcccgacttagctcgcaaaaaacgcaagtttgataagaactaa

SEQ ID NO: 2764 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCGDCRADKHKEGVAALSGGQQLALEPPDLARKKRKFDKN

SEQ ID NO: 2765 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattgtttgagtttgatagaccccgagaatcctgattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgcgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2766 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYCLSLIDPENPDCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2767 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcgggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2768 - protein, 416 aa, Artificial Sequence; identical to SEQ ID NO: 2052
  Description of Artificial Sequence: Synthetic Construct

SEQ ID NO: 2769 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatcttgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggtggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2770 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVVACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2771 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacataaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgtgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgcgtgcgtccttactatatatatgcttgcgatctttcgcttggaataggacatttccgcacgccggtatctaaaggaatcgaaattatcgaaaatttgcgcggacacacctcgggctatgcagttcctacctttgtggtacatgctccggggggtggtggtaagatacctgtgacgccgaactatgtcgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2772 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGHKDASSPSERIDRCIEYIANTPTVRDVLLSGGDALLVSDERLEYILKRLCEVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2773 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatcctgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgcgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattacgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2774 - protein, 416 aa, Artificial Sequence; identical to SEQ ID NO: 2052
  Description of Artificial Sequence: Synthetic Construct

SEQ ID NO: 2775 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2776 - protein, 416 aa, Artificial Sequence; identical to SEQ ID NO: 2052
  Description of Artificial Sequence: Synthetic Construct

SEQ ID NO: 2777 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggtgatgccctcctcgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgcgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2778 - protein, 416 aa, Artificial Sequence; identical to SEQ ID NO: 2052
  Description of Artificial Sequence: Synthetic Construct

SEQ ID NO: 2779 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2780 - protein, 416 aa, Artificial Sequence; identical to SEQ ID NO: 2052
  Description of Artificial Sequence: Synthetic Construct

SEQ ID NO: 2781 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacagatgttcgatgtactgtcgtcattgcactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacgacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2782 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDRCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2783 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgcgtgcgtccttactatatatatgcttgcgatctttcgcttggaataggacatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacgacctatacggagccggaggactatcatgaggagtgcgattgtgaggactgccgagccgacaagcacaaagagggcgtggctgcactttccggaggtcagcagttggctttagagcctcccgacttagctcgcaaaaaacgcaagtttgataagaactaa

SEQ ID NO: 2784 - protein, 416 aa, Artificial Sequence; identical to SEQ ID NO: 2052
  Description of Artificial Sequence: Synthetic Construct

SEQ ID NO: 2785 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcccaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2786 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAIPPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2787 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagggggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2788 - protein, 416 aa, Artificial Sequence
  Description of Artificial Sequence: Synthetic Construct
MAESRRKYYFPDVTDEQWYDWHWQVINRIKTLDQLEKYVTLTAEEEGGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2789 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatgcaccgacagtccgcgatgttttgctatcgggaggcgatgccctccttgtcagcgacgaacgcttggaatacatactgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcgtgcgatctttcgcttggaataggacatttccgcacgccggtatctaaaggaatcgaaattatcgaaaatttgcgcggacacacctcgggctatgctgttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2790 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANAPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2791 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2792 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVAEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2793 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcgtgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2794 - protein, 416 aa, Artificial Sequence; identical to SEQ ID NO: 2052
  Description of Artificial Sequence: Synthetic Construct

SEQ ID NO: 2795 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2796 - protein, 416 aa, Artificial Sequence; identical to SEQ ID NO: 2052
  Description of Artificial Sequence: Synthetic Construct

SEQ ID NO: 2797 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2798 - protein, 416 aa, Artificial Sequence; identical to SEQ ID NO: 2052
  Description of Artificial Sequence: Synthetic Construct

SEQ ID NO: 2799 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattgatacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2800 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLIHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2801 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcctctccttctgagcgcatcgatcgatgcattgagtatatagccaatacaccgacagtccgcgatgttttgctatcgggaggcgatgccctccttgtcagcaacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagaggttggtacatttgctggtaaagattcgtgtgcgtccttactatatatatgcttgcgatctttcgcttggaataggacatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2802 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSNERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2803 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagaggttggtacatttgctggtaaagattcgcgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgtcgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2804 - protein, 416 aa, Artificial Sequence; identical to SEQ ID NO: 2052
  Description of Artificial Sequence: Synthetic Construct

SEQ ID NO: 2805 - DNA, 1251 bp, Artificial Sequence
  Description of Artificial Sequence: Synthetic Construct
atggcagaaagtcgtagaaagtattacttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgctgttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2806 - protein, 416 aa, Artificial Sequence; identical to SEQ ID NO: 2052
  Description of Artificial Sequence: Synthetic Construct

SEQ ID NO: 2807 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcctctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttggtaagaactaa

SEQ ID NO: 2808 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFGKN

SEQ ID NO: 2809 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgctacgcaggacagaaagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcggttcctacctttgtggtacatgctccggggggtggtggtaagatacctgtgacgccgaactatgttgtatctcagtccccacgacatgtggttcttcgcaattatgaaggtgttatcacgacctatacggagccggaggactatcatgaggagtgcgattgtgaggactgccgagccgacaagcataaagagggcgtggctgcactttccggaggtcagcagttggctttagagcctcccgacttagcccgcaaaaaacgcaagtttgataagaactaa

SEQ ID NO: 2810 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRYAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2811 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcaggacagaaagatgcttcctctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgcgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacgacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2812 - protein, 416 aa, Artificial Sequence; identical to SEQ ID NO: 2052
  Description of Artificial Sequence: Synthetic Construct

SEQ ID NO: 2813 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatcttgaagcgtctgcgcgaagtacctcatgtggagattgtacgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgcgtgcgtccttactatatatatgcttgcgatctttcgcttggaataggacatttccgcacgccggtatctaaaggaatcgaaattatcgaaaatttgcgcggacacacctcgggctatgcggttcctacctttgtggtacatgctccggggggtggtggtaagatacctgtaacgccgaactatgttgtatctcagtccccacgacatgtggttcttcgcaattacgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2814 - protein, 416 aa, Artificial Sequence; identical to SEQ ID NO: 2052
  Description of Artificial Sequence: Synthetic Construct

SEQ ID NO: 2815 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaggccattcctactcaacaggaactggtacgtgctcctgaagatatggtagacccacttagtgaagataaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaggttaccgaggaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2816 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDKDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2817 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtactgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaagcgcaagttcgataagaactaa

SEQ ID NO: 2818 - protein, 416 aa, Artificial Sequence; identical to SEQ ID NO: 2052
  Description of Artificial Sequence: Synthetic Construct

SEQ ID NO: 2819 - DNA, 1251 bp, Artificial Sequence
  Description of Artificial Sequence: Synthetic Construct
atggcagaaagtcgtagaaagtattatttccctgatgtcaccgatgggcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagctattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaggttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2820 - protein, 416 aa, Artificial Sequence
  Description of Artificial Sequence: Synthetic Construct
MAESRRKYYFPDVTDGQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2821 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcggggggcgatgccctccttgtcagcgacgagcgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2822 - protein, 416 aa, Artificial Sequence; identical to SEQ ID NO: 2052
  Description of Artificial Sequence: Synthetic Construct

SEQ ID NO: 2823 - DNA, 1251 bp, Artificial Sequence
  Description of Artificial Sequence: Synthetic Construct
atggcagaaagtcgtagaaagtattatttccctgatgtcaccgatgagcaatggtacgactggtattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccctgagaatcctaactgtccgattcgtaaacaagctattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcaggacagaaagacgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagccacccgacttagctcgcaaaaagcgcaagttcgataagaactaa

SEQ ID NO: 2824 - protein, 416 aa, Artificial Sequence
  Description of Artificial Sequence: Synthetic Construct
MAESRRKYYFPDVTDEQWYDWYWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2825 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcaggacagaaagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2826 - protein, 416 aa, Artificial Sequence; identical to SEQ ID NO: 2052
  Description of Artificial Sequence: Synthetic Construct

SEQ ID NO: 2827 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagctattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgagtacatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2828 - protein, 416 aa, Artificial Sequence; identical to SEQ ID NO: 2052
  Description of Artificial Sequence: Synthetic Construct

SEQ ID NO: 2829 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaggttaccgaggaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2830 - protein, 416 aa, Artificial Sequence; identical to SEQ ID NO: 2052
  Description of Artificial Sequence: Synthetic Construct

SEQ ID NO: 2831 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccctgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctaccgttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2832 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTVVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2833 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggagtaaaagaatcgcccaaagtactccgaatggctatcacaccttattatttgagtttgatagaccctgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcgtggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2834 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERVEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2835 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgccgcttcgcaggacagaaagatgcttctactccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2836 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASTPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2837 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaggccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2838 - protein, 416 aa, Artificial Sequence; identical to SEQ ID NO: 2052
  Description of Artificial Sequence: Synthetic Construct

SEQ ID NO: 2839 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2840 - protein, 416 aa, Artificial Sequence; identical to SEQ ID NO: 2052
  Description of Artificial Sequence: Synthetic Construct

SEQ ID NO: 2841 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2842 - protein, 416 aa, Artificial Sequence; identical to SEQ ID NO: 2052
  Description of Artificial Sequence: Synthetic Construct

SEQ ID NO: 2843 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagttcgataagaactaa

SEQ ID NO: 2844 - protein, 416 aa, Artificial Sequence; identical to SEQ ID NO: 2052
  Description of Artificial Sequence: Synthetic Construct

SEQ ID NO: 2845 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2846 - protein, 416 aa, Artificial Sequence; identical to SEQ ID NO: 2052
  Description of Artificial Sequence: Synthetic Construct

SEQ ID NO: 2847 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccctgagaatcctaactgtccgattcgtaaacaagccattcctactcaacaggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2848 - protein, 416 aa, Artificial Sequence; identical to SEQ ID NO: 2052
  Description of Artificial Sequence: Synthetic Construct

SEQ ID NO: 2849 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2850 - protein, 416 aa, Artificial Sequence; identical to SEQ ID NO: 2052
  Description of Artificial Sequence: Synthetic Construct

SEQ ID NO: 2851 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaactgtccgattcgtaaacaagccattcctactcaacaggaactggtacgtgctcctgaagatatggtagacccgcttagtgaagatgaagattcgcccgtacccggactgactcatcgttatccggatcgtgtattgttcctcatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaggaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2852 - protein, 416 aa, Artificial Sequence; identical to SEQ ID NO: 2052
  Description of Artificial Sequence: Synthetic Construct

SEQ ID NO: 2853 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaggaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaagcgcaagtttgataagaactaa

SEQ ID NO: 2854 - protein, 416 aa, Artificial Sequence; identical to SEQ ID NO: 2052
  Description of Artificial Sequence: Synthetic Construct

SEQ ID NO: 2855 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggccatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2856 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGHAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2857 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaagcgcaagttcgataagaactaa

SEQ ID NO: 2858 - protein, 416 aa, Artificial Sequence; identical to SEQ ID NO: 2052
  Description of Artificial Sequence: Synthetic Construct

SEQ ID NO: 2859 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggggattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccggtatctaaaggaatcgaaatcatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2860 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVGIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2861 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcaggacagaaagacgcttcttctccttctgagcgcatcgatcgatgcattgagtatatagccaatacaccgacagtccgcgatgttttgctatcgggaggcgatgccctccttgtcagcgacgaacacttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2862 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDEHLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2863 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaggccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaggttaccgaggaagcagtggaggcttgtgaaagaatgaccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2864 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMTNAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2865 - DNA, 1251 bp, Artificial Sequence
  Description of Artificial Sequence: Synthetic Construct
atggcagaaagtcgtagaaggtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtactgttccttatcacggacaaatgttcgatgtactgtcgtcattgtactcgccgtcgcttcgcaggacagaaagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgtgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagttcgataagaactaa

SEQ ID NO: 2866 - protein, 416 aa, Artificial Sequence
  Description of Artificial Sequence: Synthetic Construct
MAESRRRYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVCPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2867 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccctgagaatcctaactgtccgattcgtaaacaggccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaggaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggaccgccgagccgacaagcataaagagggcgtggctgcactttccggaggtcagcagttggctttagagccccccgacttagctcgcaaaaaacgcaagtttgataagaactaa

SEQ ID NO: 2868 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDRRADKHKEGVAALSGGQQLALEPPDLARKKRKFDKN

SEQ ID NO: 2869 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggggtaaaagaatcgcccaaagtactccgaatggctatcacaccttattatttgagtttgatagaccctgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgctatcacaacctatacggagccggaggactatcatgaggagtgcgattgtgaggactgccgagccgacaagcataaagagggcgtggctgcactttccggaggtcagcagttggctttagagcctcccgacttagctcgcaaaaagcgcaagtttgataagaactaa

SEQ ID NO: 2870 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGAITTYTEPEDYHEECDCEDCRADKHKEGVAALSGGQQLALEPPDLARKKRKFDKN

SEQ ID NO: 2871 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaggctattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2872 - protein, 416 aa, Artificial Sequence; identical to SEQ ID NO: 2052
  Description of Artificial Sequence: Synthetic Construct

SEQ ID NO: 2873 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2874 - protein, 416 aa, Artificial Sequence; identical to SEQ ID NO: 2052
  Description of Artificial Sequence: Synthetic Construct

SEQ ID NO: 2875 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgggcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2876 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSGRIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2877 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgccgcttcgcaggacagaaagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2878 - protein, 416 aa, Artificial Sequence; identical to SEQ ID NO: 2052
  Description of Artificial Sequence: Synthetic Construct

SEQ ID NO: 2879 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgactgtgaggactgccgagccgacaagcataaagagggcgtggctgcactttccggaggtcagcagttggctttagagcctcccgacttagctcgcaaaaaacgcaagtttgataagaactaa

SEQ ID NO: 2880 - protein, 416 aa, Artificial Sequence; identical to SEQ ID NO: 2052
  Description of Artificial Sequence: Synthetic Construct

SEQ ID NO: 2881 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtgcgtgctcctgaagatatggtagacccacttagtgaagatgaagattcgcccgtacccggactgactcatcgttatccggatcgtgtactgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2882 - protein, 416 aa, Artificial Sequence; identical to SEQ ID NO: 2052
  Description of Artificial Sequence: Synthetic Construct

SEQ ID NO: 2883 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccctgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtactgttcctcatcacggacaaatgttcgatgtactgtcgtcattgtactcgccgccgcttcgcaggacagaaagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2884 - protein, 416 aa, Artificial Sequence; identical to SEQ ID NO: 2052
  Description of Artificial Sequence: Synthetic Construct

SEQ ID NO: 2885 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2886 - protein, 416 aa, Artificial Sequence; identical to SEQ ID NO: 2052
  Description of Artificial Sequence: Synthetic Construct

SEQ ID NO: 2887 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccctgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccggtatctaaaggaatcgaagttatcgaaaatttgcgcggacacacctcgggctatgcagttcctacctttgtggtacatgctccggggggtggtggtaagatacctgtaacaccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2888 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2889 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggggtaaaagaatcgcccaaagtactccgaatggctatcacaccctattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2890 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2891 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2892 - protein, 416 aa, Artificial Sequence; identical to SEQ ID NO: 2052
  Description of Artificial Sequence: Synthetic Construct

SEQ ID NO: 2893 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2894 - protein, 416 aa, Artificial Sequence; identical to SEQ ID NO: 2052
  Description of Artificial Sequence: Synthetic Construct

SEQ ID NO: 2895 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgccgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccagtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2896 - protein, 416 aa, Artificial Sequence; identical to SEQ ID NO: 2052
  Description of Artificial Sequence: Synthetic Construct

SEQ ID NO: 2897 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagcccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaggaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggcggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaagcgcaagttcgataagaactaa

SEQ ID NO: 2898 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTARDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2899 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaggctattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgaccgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtgacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcgctttccggaggtcagcagttggctttagagcctcccgacttagctcgcaaaaaacgcaagtttgataagaactaa

SEQ ID NO: 2900 - protein, 416 aa, Artificial Sequence; identical to SEQ ID NO: 2052
  Description of Artificial Sequence: Synthetic Construct

SEQ ID NO: 2901 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaagcgcaagtttgataagaactaa

SEQ ID NO: 2902 - protein, 416 aa, Artificial Sequence; identical to SEQ ID NO: 2052
  Description of Artificial Sequence: Synthetic Construct

SEQ ID NO: 2903 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactcaacaggaactggtacgtgctcctgaagatatggtagacccacttagtgaagatgaagattcgcccgtacccggactgactcatcgttatccggatcgtgtactgttcctcatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagttcgataagaactaa

SEQ ID NO: 2904 - protein, 416 aa, Artificial Sequence; identical to SEQ ID NO: 2052
  Description of Artificial Sequence: Synthetic Construct

SEQ ID NO: 2905 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagctattcctactcaacaggaactggtacgtgctcctgaagatatggtagacccgcttagtgaagatgaagattcgcccgtacccggactgactcatcgttatccggatcgtgtactgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaggttaccgaggaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaagcgcaagttcgataagaactaa

SEQ ID NO: 2906 - protein, 416 aa, Artificial Sequence; identical to SEQ ID NO: 2052
  Description of Artificial Sequence: Synthetic Construct

SEQ ID NO: 2907 - DNA, 1251 bp, Artificial Sequence
  Description of Artificial Sequence: Synthetic Construct
atggcagagagtcgtagaaagtattatttccctgatgtcaccgatgagcaatggtacgactggcattggcaggtcatcaatcgaattaagaccctcgaccagctggagaagtacgttacactcaccgctgaagaagaagagggggtaaaagaatcgcccaaagtactccgaatggctatcacaccttattatttgagtttgatagaccctgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaaggagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2908 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEGAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2909 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2910 - protein, 416 aa, Artificial Sequence; identical to SEQ ID NO: 2052
  Description of Artificial Sequence: Synthetic Construct

SEQ ID NO: 2911 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagacgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaggaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaagcgcaagttcgataagaactaa

SEQ ID NO: 2912 - protein, 416 aa, Artificial Sequence; identical to SEQ ID NO: 2052
  Description of Artificial Sequence: Synthetic Construct

SEQ ID NO: 2913 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaggccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacaccacgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaagcgcaagttcgataagaactaa

SEQ ID NO: 2914 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2915 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaagcgcaagttcgataagaactaa

SEQ ID NO: 2916 - protein, 416 aa, Artificial Sequence; identical to SEQ ID NO: 2052
  Description of Artificial Sequence: Synthetic Construct

SEQ ID NO: 2917 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaggttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2918 - protein, 416 aa, Artificial Sequence; identical to SEQ ID NO: 2052
  Description of Artificial Sequence: Synthetic Construct

SEQ ID NO: 2919 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgccgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaggttaccgaggaagcggtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2920 - protein, 416 aa, Artificial Sequence; identical to SEQ ID NO: 2052
  Description of Artificial Sequence: Synthetic Construct

SEQ ID NO: 2921 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgcgatgaagagattggtacatttgctggtaaagattcgtgtgcgtccttactatatatatgcttgcgatctttcgcttggaatagggcatttccgcacgccggtatctaaaggtatcgaaattatcgaaaatttgcgcggacacacctcgggctatgcagttcctacctttgtggtacacgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2922 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHAMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2923 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtggtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgagctatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2924 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPSYVVSQSPRHVVLRNYEGVITTYTEPEDYHEECDCEDCRADKHKEGVAALSGGQQLALEPPDLARKKRKFDKN

SEQ ID NO: 2925 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccggtatctaaaggaatcgaaattatcgaaaatttgcgcggacacacctcgggctatgcagttcctacctttgtggtacacgctccggggggtggtggtaagatacctgtaacgccgaactatgttgtatctcagtccccacgacatgttgttcttcgcaattatgaaggtgttatcacaacctatacggagccggaggactatcatgaggagtgcgattgtgaggactgccgggccgacaagcataaagagggcgtggctgcactttccggaggtcagcagttggctttagagcctcccgacttagctcgcaaaaaacgcaagtttgataagaactaa

SEQ ID NO: 2926 - protein, 416 aa, Artificial Sequence; identical to SEQ ID NO: 2052
  Description of Artificial Sequence: Synthetic Construct

SEQ ID NO: 2927 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagaccctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaggaagcggtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagtttgataagaactaa

SEQ ID NO: 2928 - protein, 416 aa, Artificial Sequence; identical to SEQ ID NO: 2052
  Description of Artificial Sequence: Synthetic Construct

SEQ ID NO: 2929 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccaactagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2930 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPTSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2931 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccattgagtgaagatgaagattcgcccgtacccggactgactcatcgttatccggatcgtgtattgttccttatcacggacaaatgttcgatgtgctgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2932 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMCCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2933 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccaattagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagtcaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagttctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2934 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPISEDEDSPVPGLTHRYPDRVLFLITDKCSMYCRHCTRRRFAGQKDASSPSERIDRCIEYIVNTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2935 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccaaagagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2936 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPKSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2937 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccagttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2938 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPVSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2939 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacacattattatttgagtttgatagaccccgagaatcctaattgtccgattcgtaaacaagccattcctactcaacaggaactggtacgtgctcctgaagatatggtagacccacatagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2940 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITHYYLSLIDPENPNCPIRKQAIPTQQELVRAPEDMVDPHSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2941 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacatagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttccgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgcggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacccatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2942 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPHSEDEDSPVPGLTHRYPDRVLFLITDKCSMYCRHCTRRRFAGQKDASSPSERIDRCIEYIANTPTVRDVLLSGGDALLVSDERLEYILKRLREVPHAEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTHTEPEDYHEECDCEDCRADKHKEGVAALSGGQQLALEPPDLARKKRKFDKN

SEQ ID NO: 2943 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacgtggttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2944 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTWLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

(The sequence listing continues in the following parts.)

What is claimed is:

1. An engineered alanine-2,3-aminomutase polypeptide having at least 90% sequence identity with SEQ ID NO:4: and which includes one or more substitutions selected from: V292A and N371D, in SEQ ID NO:4, wherein the polypeptide converts α-alanine to β-alanine.

2. A process for preparing beta-alanine, comprising contacting α-alanine with an engineered alanine-2,3-aminomutase of claim 1 under conditions suitable for conversion of α-alanine to β-alanine.

3. The process of claim 2 which is carried out with whole cells that express the engineered alanine-2,3-aminomutase, or an extract or lysate of such cells.

* * * * *